United States Patent
Deaton et al.

(10) Patent No.: US 11,866,710 B2
(45) Date of Patent: Jan. 9, 2024

(54) TRANSMEMBRANE PROTEASE, SERINE 6 (TMPRSS6) IRNA COMPOSITIONS AND METHODS OF USE THEREOF

(71) Applicant: Alnylam Pharmaceuticals, Inc., Cambridge, MA (US)

(72) Inventors: Aimee M. Deaton, Somerville, MA (US); John Michael Gansner, Newton, MA (US); James D. McIninch, Burlington, MA (US); Mark K. Schlegel, Boston, MA (US); Benjamin P. Garfinkel, Brookline, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 18/150,827

(22) Filed: Jan. 6, 2023

(65) Prior Publication Data

US 2023/0220396 A1 Jul. 13, 2023

Related U.S. Application Data

(63) Continuation of application No. PCT/US2022/026097, filed on Apr. 25, 2022.

(60) Provisional application No. 63/278,227, filed on Nov. 11, 2021, provisional application No. 63/179,607, filed on Apr. 26, 2021.

(51) Int. Cl.
  *C07H 21/04* (2006.01)
  *C12N 15/113* (2010.01)
  *A61K 47/54* (2017.01)

(52) U.S. Cl.
  CPC ........ *C12N 15/1137* (2013.01); *A61K 47/549* (2017.08); *C12Y 304/21109* (2013.01); *C12N 2310/14* (2013.01); *C12N 2310/315* (2013.01); *C12N 2310/321* (2013.01); *C12N 2310/322* (2013.01); *C12N 2310/351* (2013.01)

(58) Field of Classification Search
  None
  See application file for complete search history.

(56) References Cited

U.S. PATENT DOCUMENTS

| | | |
|---|---|---|
| 7,700,341 B2 | 4/2010 | Madison et al. |
| 9,175,290 B2 | 11/2015 | Bumcrot et al. |
| 9,783,806 B2 | 10/2017 | Butler et al. |
| 10,100,312 B2 | 10/2018 | Bumcrot et al. |
| 10,246,713 B2 | 4/2019 | Butler et al. |
| 10,829,763 B2 | 11/2020 | Butler et al. |
| 10,913,950 B2 | 2/2021 | Butler et al. |
| 10,988,768 B2 | 4/2021 | Butler et al. |
| 11,198,876 B2 | 12/2021 | Bumcrot et al. |
| 2005/0246794 A1 | 11/2005 | Khvorova et al. |
| 2007/0093443 A1 | 4/2007 | Madison et al. |
| 2008/0125384 A1 | 5/2008 | Yang |
| 2009/0191263 A1 | 7/2009 | Reich et al. |
| 2009/0192104 A1 | 7/2009 | McSwiggen et al. |
| 2009/0203135 A1 | 8/2009 | Forst et al. |
| 2012/0165393 A1 | 6/2012 | Rozema et al. |
| 2014/0194489 A1 | 7/2014 | Bumcrot et al. |
| 2014/0288158 A1 | 9/2014 | Rajeev et al. |
| 2017/0362594 A1 | 12/2017 | Butler et al. |
| 2018/0087058 A1 | 3/2018 | Butler et al. |
| 2021/0163952 A1 | 6/2021 | Butler et al. |
| 2021/0254076 A1 | 8/2021 | Butler et al. |
| 2022/0251570 A1 | 8/2022 | Bumcrot et al. |

FOREIGN PATENT DOCUMENTS

| | | |
|---|---|---|
| EP | 1752536 A1 | 2/2007 |
| WO | WO-1998/013526 A1 | 4/1998 |
| WO | WO-2004/045543 A2 | 6/2004 |
| WO | WO-2005/116204 A1 | 12/2005 |
| WO | WO-2007053696 A2 | 5/2007 |
| WO | WO-2009/073809 A2 | 6/2009 |
| WO | WO-2009082607 A2 | 7/2009 |
| WO | WO-2010/033246 A1 | 3/2010 |
| WO | WO-2010099341 A1 | 9/2010 |
| WO | WO-2010/148013 A2 | 12/2010 |
| WO | WO-2012/135246 A2 | 10/2012 |
| WO | WO-2012177784 A2 | 12/2012 |

(Continued)

OTHER PUBLICATIONS

Schmidt et al., "RNAi-mediated reduction of hepatic Tmprss6 diminishes anemia and secondary iron overload in a splenectomized mouse model of ß-thalassemia intermedia", American Journal of Hematology, vol. 93, No. 6, Mar. 23, 2018 (Mar. 23, 2018), pp. 745-750.
International Search Report and Written Opinion from PCT/US2022/026097, dated Sep. 27, 2022.
D'Aquino, KE et al., The protein kinase Kin4 inhibits exit from mitosis in response to spindle position defects. Mol Cell. Jul. 22, 2005;19(2):223-34.
Finberg, K et al., Down-regulation of Bmp/Smad signaling by Tmprss6 is required for maintenance of systemic iron homeostasis. Blood. May 6, 2010;115(18):3817-26. doi: 10.1182/blood-2009-05-224808. Epub Mar. 3, 2010.
Lakhal, S et al., Regulation of type II transmembrane serine proteinase TMPRSS6 by hypoxia-inducible factors: new link between hypoxia signaling and iron homeostasis. J Biol Chem. Feb. 11, 2011;286(6):4090-7. Epub Oct. 21, 2010.

(Continued)

*Primary Examiner* — Kimberly Chong
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNA (dsRNA) agents, targeting the Transmembrane protease, serine 6 (TMPRSS6) gene. The invention also relates to methods of using such RNAi agents to inhibit expression of a TMPRSS6 gene and to methods of preventing and treating a TMPRSS6-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

46 Claims, 4 Drawing Sheets

Specification includes a Sequence Listing.

(56) References Cited

FOREIGN PATENT DOCUMENTS

| WO | WO-2013/070786 A1 | 5/2013 |
| --- | --- | --- |
| WO | WO-2014/190157 A1 | 11/2014 |
| WO | WO-2016/085852 A1 | 6/2016 |
| WO | WO-2020/021108 A2 | 1/2020 |
| WO | WO-2022/231999 A1 | 11/2022 |

OTHER PUBLICATIONS

Maxon et al., Matriptase-2- and proprotein convertase-cleaved forms of hemojuvelin have different roles in the down-regulation of hepcidin expression. J Biol Chem. Dec. 10, 2010;285(50):39021-8. doi: 10.1074/jbc.M110.183160. Epub Oct. 11, 2010.

NCBI_NM_153609.2, *Homo sapiens* transmembrane protease, serine 6 (TMPRSS6), mRNA. Nov. 18, 2006. Version available on Pri Apr. 28, 2012 per sequence retreived in International Search Report dated May 30, 2012.. Retreived on Feb. 26, 2016 at http://www.ncbi.nlm.nih.gov/nuccore/56682967?sat=15&satkey=9882477.

Sisay et al., Identification of the first low-molecular-weight inhibitors of matriptase-2. J Med Chem. Aug. 12, 2010;53(15):5523-35. doi: 10.1021/jm100183e.

International Search Report and Written Opinion for International Application No. PCT/US2014/039149, dated Sep. 1, 2014.

GenBank Acession NM_001130556; Aug. 28, 2012 [online] downloaded from: http://www.ncbi.nlm.nih.gov/nuccore/NM_001130556/ on Jan. 30, 2017.

GenBank Acession CU691658 ; Feb. 23, 2008 [online] downloaded from: http://www.ncbi.nlm.nih.gov/nuccore/CU691658 on Jan. 30, 2017.

GenBank Acession CU013044; Oct. 7, 2008 [online] downloaded from: http://www.ncbi.nlm.nih.gov/nuccore/CU013044/ on Jan. 30, 2017.

GenBank Acession AY358398; Oct. 3, 2003 [online] downloaded from: http://www.ncbi.nlm.nih.gov/nuccore/37181920/ on Jan. 30, 2017.

GenBank Acession CR456446; Oct. 16, 2008 [online] downloaded from: http://www.ncbi.nlm.nih.gov/nuccore/CR456446/ on Jan. 30, 2017.

GenBank Acession HV848938; Nov. 15, 2012 [online] downloaded from: http://www.ncbi.nlm.nih.gov/nuccore/HV848938 on Jan. 30, 2017.

GenBank Acession HV784394; Nov. 15, 2012 [online] downloaded from: http://www.ncbi.nlm.nih.gov/nuccore/HV784394 on Jan. 30, 2017.

GenBank Acession HI141555; Nov. 2, 2010 [online] downloaded from: http://www.ncbi.nlm.nih.gov/nuccore/HI141555 on Jan. 30, 2017.

GenBank Acession GX268669; Aug. 13, 2010 [online] downloaded from: http://www.ncbi.nlm.nih.gov/nuccore/303211976 on Jan. 30, 2017.

GenBank Acession DM472417; Jan. 21, 2010 [online] downloaded from: http://www.ncbi.nlm.nih.gov/nuccore/DM472417 on Jan. 30, 2017.

GenBank Acession DM180171; Aug. 26, 2009 [online] downloaded from: http://www.ncbi.nlm.nih.gov/nuccore/DM180171 on Jan. 30, 2017.

GenBank Acession DM117477; Jun. 18, 2009 [online] downloaded from: http://www.ncbi.nlm.nih.gov/nuccore/DM117477 on Jan. 30, 2017.

GenBank Acession FB762896; Dec. 18, 2008 [online] downloaded from: http://www.ncbi.nlm.nih.gov/nuccore/FB762896 on Jan. 30, 2017.

GenBank Acession DJ429262; Jun. 11, 2008 [online] downloaded from: http://www.ncbi.nlm.nih.gov/nuccore/DJ429262 on Jan. 30, 2017.

GenBank Acession DI008490; Feb. 21, 2008 [online] downloaded from: http://www.ncbi.nlm.nih.gov/nuccore/DI008490 on Jan. 30, 2017.

GenBank Acession DI066240; Feb. 21, 2008 [online] downloaded from: http://www.ncbi.nlm.nih.gov/nuccore/DI066240 on Jan. 30, 2017.

Elbashir et al, "Functional anatomy of siRNAs for mediating efficient RNAi in *Drosophila melanogaster* embryo lysate", Embo J. Dec. 3, 2001; 20(23): 6877-6888.

Reynolds et al., "Rational siRNA design for RNA interference," Nature Biotechnology, vol. 22, pp. 326-330, 2004.

Finberg et al. "Tmprss6, An Inhibitor of Hepatic Bmp/Smad Signaling, Is Required for Hepcidin Suppression and Iron Loading In a Mouse Model of ß-Thalassemia," Blood 2010 116:164.

Velasco et al., "Matriptase-2, a membrane-bound mosaic serine proteinase predominantly expressed in human liver and showing degrading activity against extracellular matrix proteins.", J Biol Chem. Oct. 4, 2002;277(40):37637-46.

Ramsay et al. "Matriptase-2 (TMPRSS6): a proteolytic regulator of iron homeostasis," Haematologica. Jun. 2009; 94(6): 840-849.

Finberg et al., "Tmprss6 is a genetic modifier of the Hfe-hemochromatosis phenotype in mice", Blood, Apr. 28, 2011, vol. 117(17) 4590-4599.

International Search Report and Written Report from PCT/US2015/062141 dated Mar. 11, 2016.

Bertrand et al, "Comparison of antisense oligonucleotides and siRNAs in cell culture and in vivo", hemical and Biophysical Research Communications 296 (2002) 1000-1004.

Database Biosis [Online] Biosciences Information Service, Philadelphia, PA, US, Nov. 2010, Finberg, K. et al., "Tmprss6, An Inhibitor of Hepatic Bmp/SmadSignaling, is required for Hepcidin suppression and iron loading in a mouse model of beta-thalassemia", XP002737926, Database accession No. PREV201100422711 & Blood, vol. 116, No. 21, Nov. 2010, p. 75, 52nd Annual Meeting of the American Society ofHematology (ASH); Orlando, FL, USA; Dec. 4-7, 2010.

International Search Report and Written Opinion dated Sep. 4, 2012 from International Application No. PCT/US12/30786.

Partial Supplementary European Search Report in European Application No. 12763700.7 dated Apr. 9, 2015.

Kumiko Tei, et al., "RNAi Experiments—Q&A Self-Study Guide" 2006, published by Yodosha Co., Ltd., p. 52 and 53 and 88-96—Partial English Translation.

Park et al. "Cloning and Characterization of TMPRSS6, a Novel Type 2 Transmembrane Serine Protease" Molecules and Cells (2005) vol. 19, No. 2, pp. 223-227.

Vickers et al., Efficient Reduction of Target RNAs by Small Interfering RNA and RNase H-dependent Antisense Agents, J Biol Chem. Feb. 28, 2003;278(9):7108-18.

Watts et al., "Gene silencing by siRNAs and antisense oligonucleotides in the laboratory and the clinic", *J Pathol.* Jan. 2012 ; 226(2): 365-379.

Extended European Search Report for European Application No. 19207174.4 dated May 18, 2020.

U.S. Appl. No. 14/947,025 U.S. Pat. No. 9,783,806, filed Nov. 20, 2015 Oct. 10, 2017, US 20160145629, Granted.

U.S. Appl. No. 15/695,254, filed Sep. 5, 2017, US 20180087058, Abandoned.

U.S. Appl. No. 16/191,579 U.S. Pat. No. 10,913,950, filed Nov. 15, 2018 Feb. 9, 2021, US 20190211341, Granted.

U.S. Appl. No. 16/996,089 U.S. Pat. No. 10,988,768, filed Aug. 18, 2020 Apr. 27, 2021, US 20200392511, Granted.

U.S. Appl. No. 17/121,885, filed Dec. 15, 2020, US 20210254076, Published.

PCT/US2014/039149, May 22, 2014, WO 2014/190157, Completed.

U.S. Appl. No. 15/603,560 U.S. Pat. No. 10,246,713, filed May 24, 2017 Apr. 2, 2019, US 20170362594, Granted.

U.S. Appl. No. 16/269,666 U.S. Pat. No. 10,829,763, filed Feb. 7, 2019 Nov. 10, 2020, US 20190284562, Granted.

U.S. Appl. No. 17/062,748, filed Oct. 5, 2020, US 20210163952, Published.

PCT/US2015/062141, Nov. 23, 2015, WO2016/085852, Completed.

U.S. Appl. No. 14/007,835 U.S. Pat. No. 9,175,290, filed Feb. 7, 2014 Nov. 3, 2015, US 20140194489, Granted.

(56) References Cited

OTHER PUBLICATIONS

U.S. Appl. No. 14/866,148 U.S. Pat. No. 10,100,312, filed Sep. 25, 2015 Oct. 16, 2018, US 20160145626, Granted.
U.S. Appl. No. 16/121,265 U.S. Pat. No. 11,198,876, filed Sep. 4, 2018 Dec. 14, 2021, US 20190119685, Granted.
U.S. Appl. No. 17/510,958, filed Oct. 26, 2021, US 20220251570, Published.
PCT/US2012/030786, Mar. 28, 2012, WO 2012/135246, Completed.
PCT/US2022/026097, Apr. 25, 2022, WO 2022/231999, Published.

TRANSMEMBRANE PROTEASE, SERINE 6 (TMPRSS6) IRNA COMPOSITIONS AND METHODS OF USE THEREOF

RELATED APPLICATIONS

This application is a 35 § U.S.C. 111(a) continuation application which claims the benefit of priority to PCT/US2022/026097, filed on Apr. 25, 2022, which, in turn, claims the benefit of priority to U.S. Provisional Application No. 63/179,607, filed on Apr. 26, 2021, and U.S. Provisional Application No. 63/278,227, filed on Nov. 11, 2021. The entire contents of each of the foregoing applications are incorporated herein by reference.

SEQUENCE LISTING

The instant application contains a Sequence Listing which has been filed electronically in XML file format and is hereby incorporated by reference in its entirety. Said XML copy, created on Dec. 21, 2022, is named 121301-015403_SL.xml and is 18,616,211 bytes in size.

BACKGROUND OF THE INVENTION

TMPRSS6 (Transmembrane Protease, Serine 6), also known as matriptase-2, is a type II serine protease. It is primarily expressed in the liver, although high levels of TMPRSS6 mRNA are also found in the kidney, with lower levels in the uterus and much smaller amounts detected in many other tissues (Beliveau et al., 2019, *Cell Chemical Biology* 26, 1559-1572). TMPRSS6 plays a key role in iron homeostatis via modulation of hepcidin expression. Hepcidin, a liver-derived peptide hormone, is known as a central regulator of systemic iron homeostasis, and its unbalanced production contributes to the pathogeesis of a spectrum of iron disorders. Hepcidin functions by blocking the absorption of dietary iron from the intestine, and the release of iron from macrophages and hepatocytes (Ganz T. 2011, *Blood*, vol. 117, 17, 4425-4433). Hepcidin gene expression can be stimulated in response to iron through BMP/SMAD-dependent signal transduction cascade mediated by the BMP-co-receptor hemojuvelin (HJV). TMPRSS6 inhibits BMP-mediated upregulation of hepcidin by cleaving the BMP co-receptor HJV, thus preventing BMP signaling, SMAD translocation to the nucleus, and hepcidin transcriptional activation, which causes downregulation of hepcidin levels (Finberg, K. E., et al., 2010, *Blood* 115, 3817-3826; Wang, C. Y., et al., 2014 *Front. Pharmacol.* 5, 114).

Therefore, inhibition of TMPRSS6 results in increased hepcidin levels, making it an attractive pharmacological target for disorders associated with iron overload and inappropriately low hepcidin or for disorders where iron restriction is desirable. Numerous disorders, such as thalassemias, hemochromatosis, and certain types of myelodysplastic syndromes (MDS), are associated with iron overload, a condition characterized by increased levels of iron. Iron overload can result in excess iron deposition in various tissues and can eventually lead to tissue and organ damage. In addition, iron restriction is desirable in certain disorders such as polycythemia vera.

Current treatments for disorders associated with iron overload and disorders where iron restriction is desirable (e.g. polycythemia vera) include phlebotomy or venesection, a treatment to remove iron-rich blood from the body; splenectomy; iron chelation therapy; and dieting. However, these treatments are not always effective. Accordingly, there is a need in the art for alternative treatments for subjects having disorders associated with iron overload.

SUMMARY OF THE INVENTION

The present invention provides iRNA compositions which affect the RNA-induced silencing complex (RISC)-mediated cleavage of RNA transcripts of a gene encoding Transmembrane protease, serine 6 (TMPRSS6). The TMPRSS6 gene may be within a cell, e.g., a cell within a subject, such as a human subject. The present invention also provides methods of using the iRNA compositions of the invention for inhibiting the expression of a TMPRSS6 gene and/or for treating a subject who would benefit from inhibiting or reducing the expression of a TMPRSS6 gene, e.g., a subject suffering or prone to suffering from a TMPRSS6-associated disorder, e.g., an iron overload associated disorder and/or a disorder of ineffective erythopoiesis, such as thalassemia, e.g., β-thalassemia, hemochromatosis, myelodysplastic syndromes (MDS), or polycythemia vera.

Accordingly, in an aspect, the present invention provides a double stranded ribonucleic acid (dsRNA) for inhibiting expression of Transmembrane protease, serine 6 (TMPRSS6) in a cell, wherein said dsRNA comprises a sense strand and an antisense strand forming a double stranded region, wherein the antisense strand comprises a region of complementarity to an mRNA encoding TMPRSS6, and wherein the region of complementarity comprises at least 15, e.g., 15, 16, 17, 18, 19, or 20, contiguous nucleotides differing by no more than 0, 1, 2, or 3 nucleotides from any one of the antisense nucleotide sequences in any one of Tables 2-7.

In one embodiment, the dsRNA agent comprises a sense strand comprising a contiguous nucleotide sequence which has at least 85%, e.g., 85%, 90%, 91%, 92%, 93%, 94%, 95%, 96%, 97%, 98%, 99%, or 100%, nucleotide sequence identity over its entire length to any one of the nucleotide sequences of the sense strands in any one of Tables 2-7 and an antisense strand comprising a contiguous nucleotide sequence which has at least 85%, e.g., 85%, 90%, 91%, 92%, 93%, 94%, 95%, 96%, 97%, 98%, 99%, or 100%, nucleotide sequence identity over its entire length to any one of the nucleotide sequences of the antisense strands in any one of Tables 2-7.

In one embodiment, the dsRNA agent comprises a sense strand comprising at least 15, e.g., 15, 16, 17, 18, 19, 20, or 21, contiguous nucleotides differing by no more than three nucleotides from any one of the nucleotide sequences of the sense strands in any one of Tables 2-7 and an antisense strand comprising at least 15, e.g., 15, 16, 17, 18, 19, 20, or 21, contiguous nucleotides differing by no more than three nucleotides from any one of the nucleotide sequences of the antisense strands in any one of Tables 2-7.

In one embodiment, the dsRNA agent comprises a sense strand comprising at least 15, e.g., 15, 16, 17, 18, 19, 20, or 21, contiguous nucleotides differing by no more than two nucleotides from any one of the nucleotide sequences of the sense strands in any one of Tables 2-7 and an antisense strand comprising at least 15, e.g., 15, 16, 17, 18, 19, 20, or 21, contiguous nucleotides differing by no more than two nucleotides from any one of the nucleotide sequences of the antisense strands in any one of Tables 2-7.

In one embodiment, the dsRNA agent comprises a sense strand comprising at least 15, e.g., 15, 16, 17, 18, 19, 20, or 21, contiguous nucleotides differing by no more than one nucleotide from any one of the nucleotide sequences of the sense strands in any one of Tables 2-7 and an antisense strand comprising at least 15, e.g., 15, 16, 17, 18, 19, 20, or 21, contiguous nucleotides differing by no more than one nucleotide from any one of the nucleotide sequences of the antisense strands in any one of Tables 2-7.

In one embodiment, the dsRNA agent comprises a sense strand comprising or consisting of a nucleotide sequence selected from the group consisting of any one of the nucleotide sequences of the sense strands in any one of Tables 2-7 and an antisense strand comprising or consisting of a nucleotide sequence selected from the group consisting of any one of the nucleotide sequences of the antisense strands in any one of Tables 2-7.

In one aspect, the present invention provides a double stranded ribonucleic acid (dsRNA) for inhibiting expression of Transmembrane protease, serine 6 (TMPRSS6) in a cell, wherein said dsRNA comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 187-210; 227-254; 322-363; 362-390; 398-420; 404-429; 410-435; 439-461; 443-467; 448-474; 460-483; 466-488; 496-519; 519-542; 526-548; 557-593; 641-671; 652-676; 687-713; 725-762; 757-794; 886-908; 921-951; 956-987; 1051-1082; 1233-1269; 1279-1313; 1313-1341; 1327-1351; 1415-1439; 1447-1480; 1464-1486; 1486-1509; 1559-1589; 1571-1595; 1579-1609; 1707-1735; 1738-1764; 1806-1828; 1864-1886; 1934-1966; 1967-1991; 2008-2031; 2015-2043; 2042-2072; 2287-2311; 2297-2354; 2336-2361; 2360-2384; 2416-2438; 2481-2510; 2496-2527; 2526-2558; 2665-2693; 2693-2719; 2707-2729; 2799-2821; 2851-2874; 2971-2999; 2981-3006 and 3155-3195 of SEQ ID NO: 1, and the antisense strand comprises at least 15 contiguous nucleotides differing by no more than 3, e.g., 3, 2, 1, or 0, nucleotides from the corresponding nucleotide sequence of SEQ ID NO:2.

In one aspect, the present invention provides a double stranded ribonucleic acid (dsRNA) agent for inhibiting expression of Transmembrane protease, serine 6 (TMPRSS6) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 230-252, 324-346, 560-578, 560-582, 2338-2360, 3163-3185, 3169-3191, and 3172-3194 of SEQ ID NO: 1, and the antisense strand comprises at least 15, e.g., 15, 16, 17, 18, 19, 20, or 21, contiguous nucleotides differing by no more than three, e.g., 3, 2, 1, or 0, nucleotides from the corresponding nucleotide sequence of SEQ ID NO:2.

In one aspect, the present invention provides a double stranded ribonucleic acid (dsRNA) agent for inhibiting expression of Transmembrane protease, serine 6 (TMPRSS6) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 560-578, 2338-2360, and 3169-3191 of SEQ ID NO: 1, and the antisense strand comprises at least 15, e.g., 15, 16, 17, 18, 19, 20, or 21, contiguous nucleotides differing by no more than 3, e.g., 3, 2, 1, or 0, nucleotides from the corresponding nucleotide sequence of SEQ ID NO:2.

In some embodiments, the antisense strand comprises at least 15, e.g., 15, 16, 17, 18, 19, 20, or 21, contiguous nucleotides differing by no more than three, e.g., 3, 2, 1, or 0, nucleotides from any one of the antisense strand nucleotide sequences of a duplex selected from the group consisting of AD-1556360, AD-1571158, AD-1571033, AD-1554875, AD-1571160, AD-1555117, AD-1554911, and AD-1556915.

In some embodiments, the antisense strand comprises at least 15, e.g., 15, 16, 17, 18, 19, 20, or 21, contiguous nucleotides differing by no more than three, e.g., 3, 2, 1, or 0, nucleotides from any one of the antisense strand nucleotide sequences of a duplex selected from the group consisting of AD-1556360, AD-1571158, and AD-1571033.

In one embodiment, the dsRNA agent comprises at least one modified nucleotide.

In one embodiment, substantially all of the nucleotides of the sense strand; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), a nucleotide comprising a 2' phosphate, and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, a nucleotide with a 2' phosphate, e.g., G2p, C2p, A2p or U2p, and, a vinyl-phosphonate nucleotide; and combinations thereof.

In some embodiments, the modified nucleotide comprises a short sequence of 3'-terminal deoxythimidine nucleotides (dT).

In some embodiments, the dsRNA agent further comprises at least one phosphorothioate internucleotide linkage. In some embodiments, the dsRNA agent comprises 6-8 phosphorothioate internucleotide linkages. In one embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand. In another embodiment, the phosphorothioate or methylphosphonate internucleotide linkage is at the both the 5'- and 3'-terminus of one strand. Optionally, the strand is the antisense strand. In another embodiment, the strand is the sense strand.

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; between 19 and 23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is conjugated to the 5' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

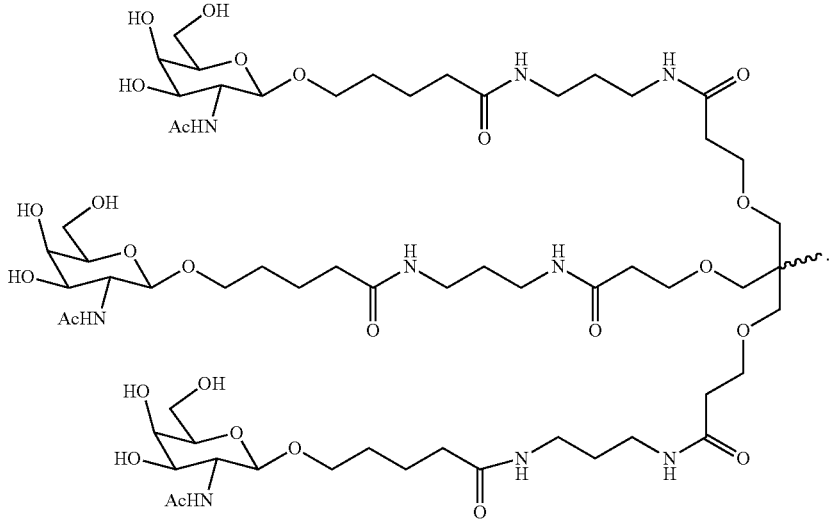 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

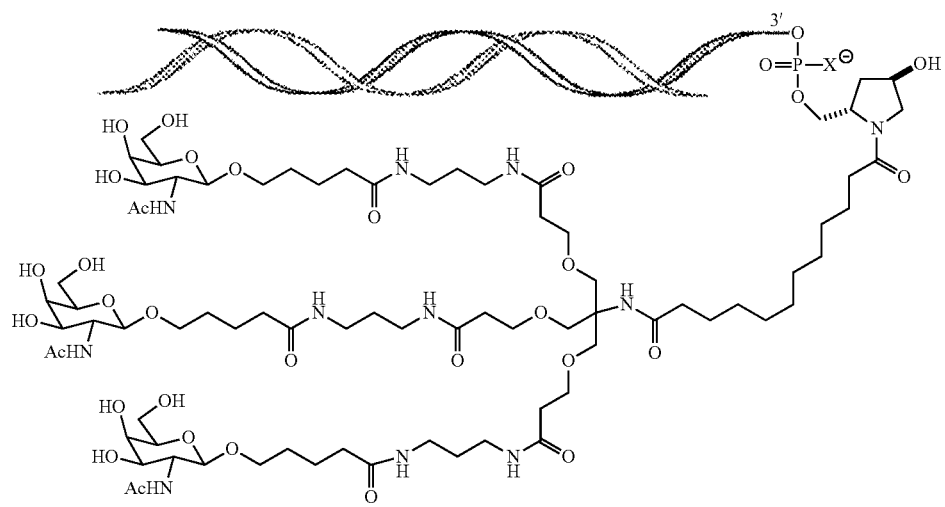

and, wherein X is O or S.

In one embodiment, the X is O.

In one embodiment, the dsRNA agent is conjugated to the ligand as shown in the following schematic

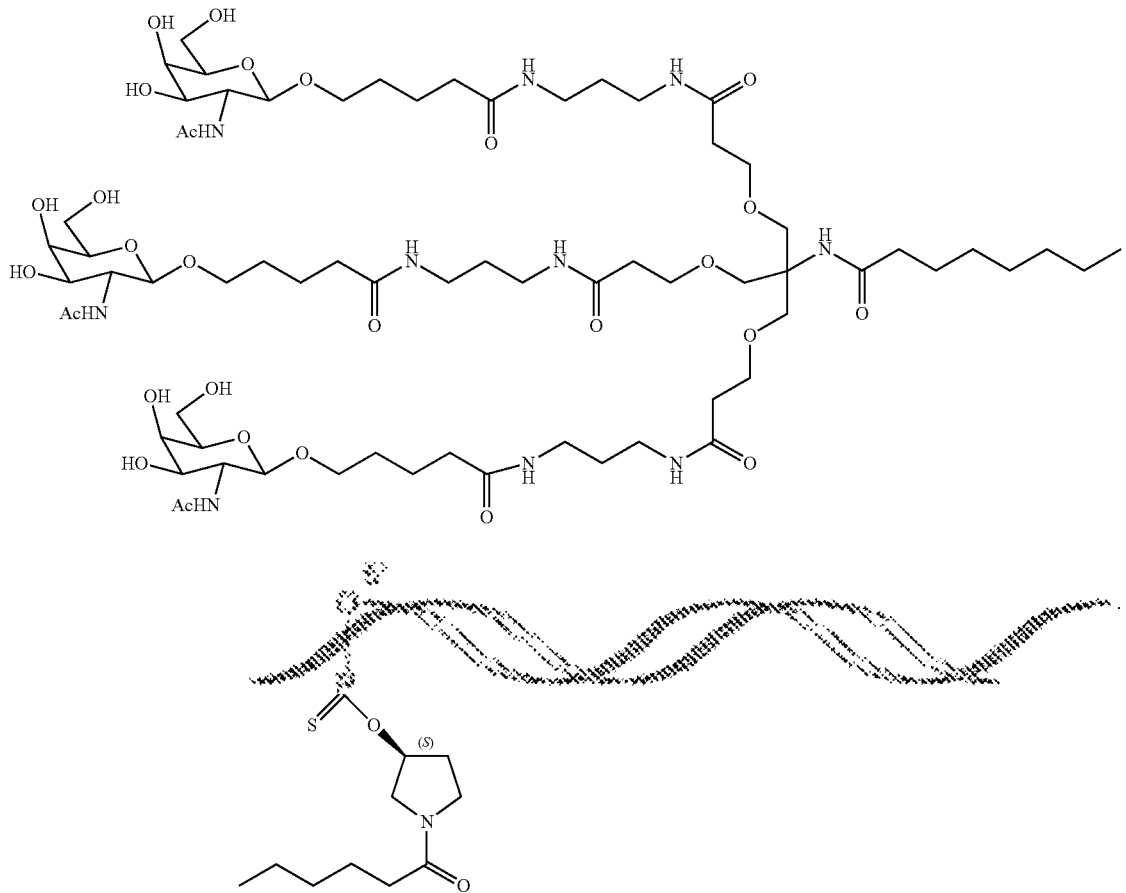

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

In one embodiment, the sense strand comprises at least 17 contiguous nucleotides differing by no more than 0, 1, 2, or 3 nucleotides from the nucleotide sequence of 5'-GACGCCACGCAUGCUGUGUGU-3'(SEQ ID NO: 119).

In one embodiment, the sense strand comprises at least 19 contiguous nucleotides differing by no more than 0, 1, 2, or 3 nucleotides from the nucleotide sequence of 5'-GACGCCACGCAUGCUGUGUGU-3'(SEQ ID NO: 119).

In one embodiment, the sense strand comprises or consists of the nucleotide sequence of 5'-GACGCCACGCAUGCUGUGUGU-3'(SEQ ID NO: 119).

In one embodiment, the antisense strand comprises at least 17 contiguous nucleotides differing by no more than 0, 1, 2, or 3 nucleotides from the nucleotide sequence of 5'-ACACACAGCAUGCGUGGCGUCAC-3' (SEQ ID NO: 245).

In one embodiment, the antisense strand comprises at least 19 contiguous nucleotides differing by no more than 0, 1, 2, or 3 nucleotides from the nucleotide sequence of 5'-ACACACAGCAUGCGUGGCGUCAC-3' (SEQ ID NO: 245).

In one embodiment, the antisense strand comprises at least 21 contiguous nucleotides differing by no more than 0, 1, 2, or 3 nucleotides from the nucleotide sequence of 5'-ACACACAGCAUGCGUGGCGUCAC-3' (SEQ ID NO: 245).

In one embodiment, the antisense strand comprises or consists of the nucleotide sequence of 5'-ACACACAGCAUGCGUGGCGUCAC-3' (SEQ ID NO: 245).

In one embodiment, the sense strand comprises the nucleotide sequence of 5'-GACGCCACGCAUGCUGUGUGU-3'(SEQ ID NO: 119) and the antisense strand comprises the nucleotide sequence of 5'-ACACACAGCAUGCGUGGCGUCAC-3' (SEQ ID NO: 245).

In one embodiment, the sense strand differs by no more than 3, e.g., 0, 1, 2, or 3, modified nucleotides from the nucleotide sequence of 5'-gsascgccacGfCfAfugcugugugu-3' (SEQ ID NO:371) wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

In one embodiment, the antisense strand differs by no more than 3, e.g., 0, 1, 2, or 3, modified nucleotides from the nucleotide sequence of 5'-asdCsacdAcdAgcaudGcGfuggcgucsasc-3' (SEQ ID NO: 497), wherein a, g, c and u are 2'-O-methyl (2'-OMe) A, G, C, and U respectively; Af, Gf, Cf and Uf are 2'-fluoro A, G, C and U respectively; wherein dA, dG, and dC are 2'-deoxyadenosine-3'-phosphate, 2'-deoxyguanosine-3'-phosphate, and 2'-deoxycytidine-3'-phosphate respectively; and s is a phosphorothioate linkage.

In one embodiment, the sense strand comprises the nucleotide sequence of 5'-gsascgccacGfCfAfugcugugugu-3' (SEQ ID NO: 371) and the antisense strand comprises the nucleotide sequence of 5'-asdCsacdAcdAgcaudGcGfuggcgucsasc-3' (SEQ ID NO: 497), wherein a, g, c and u are 2'-O-methyl (2'-OMe) A, G, C, and U respectively; Af, Gf, Cf and Uf are 2'-fluoro A, G, C and U respectively; wherein dA, dG, and dC are 2'-deoxyadenosine-3'-phosphate, 2'-deoxyguanosine-3'-phosphate, and 2'-deoxycytidine-3'-phosphate respectively; and s is a phosphorothioate linkage.

In one embodiment, the sense strand comprises the nucleotide sequence of 5'-gsascgccacGfCfAfugcuguguguL96-3' (SEQ ID NO: 2331) and the antisense strand comprises the nucleotide sequence of 5'-asdCsacdAcdAgcaudGcGfuggcgucsasc-3' (SEQ ID NO: 497), wherein a, g, c and u are 2'-O-methyl (2'-OMe) A, G, C, and U respectively; Af, Gf, Cf and Uf are 2'-fluoro A, G, C and U respectively; wherein dA, dG, and dC are 2'-deoxyadenosine-3'-phosphate, 2'-deoxyguanosine-3'-phosphate, and 2'-deoxycytidine-3'-phosphate respectively; s is a phosphorothioate linkage, and L96 is N-[tris(GalNAc-alkyl)-amidodecanoyl)]-4-hydroxyprolinol.

In one embodiment, the sense strand comprises the nucleotide sequence of 5'-gsascgccacGfCfAfugcugugugu-3' (SEQ ID NO: 371) and the antisense strand comprises the nucleotide sequence of 5'-asdCsacdAcdAgcaudGcGfuggcgucsasc-3' (SEQ ID NO: 497), wherein a, g, c and u are 2'-O-methyl (2'-OMe) A, G, C, and U respectively; Af, Gf, Cf and Uf are 2'-fluoro A, G, C and U respectively; wherein dA, dG, and dC are 2'-deoxyadenosine-3'-phosphate, 2'-deoxyguanosine-3'-phosphate, and 2'-deoxycytidine-3'-phosphate respectively; and s is a phosphorothioate linkage, wherein the 3'-end of the sense strand is conjugated to the ligand as shown in the following schematic:

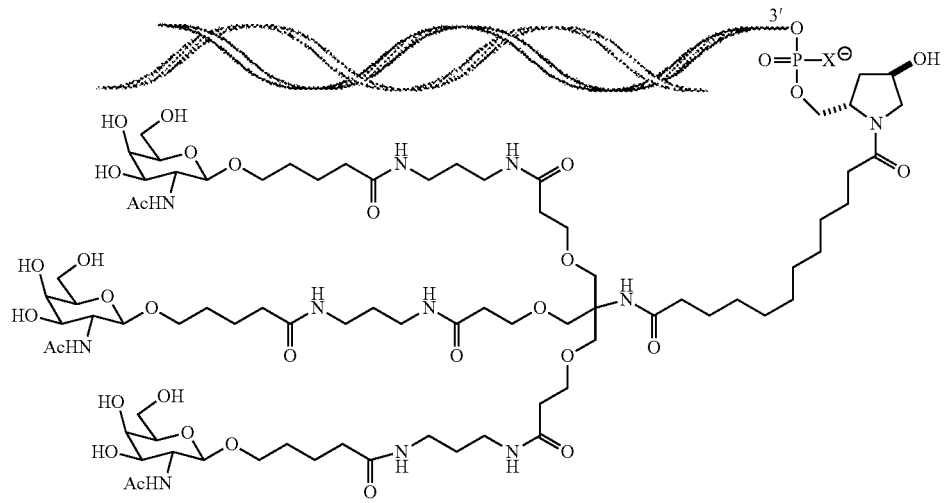

and, wherein X is O.

In one embodiment, the sense strand comprises at least 17 contiguous nucleotides differing by no more than 0, 1, 2, or 3 nucleotides from the nucleotide sequence of 5'-CCUUUGGAAUAAAGCUGCCUU-3' (SEQ ID NO: 844).

In one embodiment, the sense strand comprises at least 19 contiguous nucleotides differing by no more than 0, 1, 2, or 3 nucleotides from the nucleotide sequence of 5'-CCUUUGGAAUAAAGCUGCCUU-3' (SEQ ID NO: 844).

In one embodiment, the sense strand comprises or consists of the nucleotide sequence of 5'-CCUUUGGAAUAAAGCUGCCUU-3' (SEQ ID NO: 844).

In one embodiment, the antisense strand comprises at least 17 contiguous nucleotides differing by no more than 0, 1, 2, or 3 nucleotides from the nucleotide sequence of 5'-AAGGCAGCUUUAUUCCAAAGGGC-3' (SEQ ID NO: 1868).

In one embodiment, the antisense strand comprises at least 19 contiguous nucleotides differing by no more than 0, 1, 2, or 3 nucleotides from the nucleotide sequence of 5'-AAGGCAGCUUUAUUCCAAAGGGC-3' (SEQ ID NO: 1868).

In one embodiment, the antisense strand comprises at least 21 contiguous nucleotides differing by no more than 0, 1, 2, or 3 nucleotides from the nucleotide sequence of 5'-AAGGCAGCUUUAUUCCAAAGGGC-3' (SEQ ID NO: 1868).

In one embodiment, the antisense strand comprises or consists of the nucleotide sequence of 5'-AAGGCAGCUUUAUUCCAAAGGGC-3' (SEQ ID NO: 1868).

In one embodiment, the sense strand comprises the nucleotide sequence of 5'-CCUUUGGAAUAAAGCUGCCUU-3' (SEQ ID NO: 844) and the antisense strand comprises the nucleotide sequence of 5'-AAGGCAGCUUUAUUCCAAAGGGC-3' (SEQ ID NO: 1868).

In one embodiment, the sense strand differs by no more than 3, e.g., 0, 1, 2, or 3, modified nucleotides from the nucleotide sequence of 5'-cscsuuugGfaAfUfAfaagcugccuu-3' (SEQ ID NO: 2095) wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

In one embodiment, the antisense strand differs by no more than 3, e.g., 0, 1, 2, or 3, modified nucleotides from the nucleotide sequence of 5'-asAfsggdCa(G2p)cuuuauUfcCfaaaggsgsc-3' (SEQ ID NO: 2324), wherein a, g, c and u are 2'-O-methyl (2'-OMe) A, G, C, and U respectively; Af, Gf, Cf and Uf are 2'-fluoro A, G, C and U respectively; wherein G2p is guanosine-2'-phosphate; and s is a phosphorothioate linkage.

In one embodiment, the sense strand comprises the nucleotide sequence of 5'-cscsuuugGfaAfUfAfaagcugccuu-3' (SEQ ID NO: 2095) and the antisense strand comprises the nucleotide sequence of 5'-asAfsggdCa(G2p)cuuuauUfcCfaaaggsgsc-3' (SEQ ID NO: 2324), wherein a, g, c and u are 2'-O-methyl (2'-OMe) A, G, C, and U respectively; Af, Gf, Cf and Uf are 2'-fluoro A, G, C and U respectively; wherein G2p is guanosine-2'-phosphate; and s is a phosphorothioate linkage.

In one embodiment, the sense strand comprises the nucleotide sequence of 5'-cscsuuugGfaAfUfAfaagcugccuuL96-3' (SEQ ID NO: 2333) and the antisense strand comprises the nucleotide sequence of 5'-asAfsggdCa(G2p)cuuuauUfcCfaaaggsgsc-3' (SEQ ID NO: 2324), wherein a, g, c and u are 2'-O-methyl (2'-OMe) A, G, C, and U respectively; Af, Gf, Cf and Uf are 2'-fluoro A, G, C and U respectively; wherein G2p is guanosine-2'-phosphate; s is a phosphorothioate linkage, and L96 is N-[tris(GalNAc-alkyl)-amidodecanoyl)]-4-hydroxyprolinol.

In one embodiment, the sense strand comprises the nucleotide sequence of 5'-cscsuuugGfaAfUfAfaagcugccuu-3' (SEQ ID NO: 2095) and the antisense strand comprises the nucleotide sequence of 5'-asAfsggdCa(G2p)cuuuauUfcCfaaaggsgsc-3' (SEQ ID NO: 2324), wherein a, g, c and u are 2'-O-methyl (2'-OMe) A, G, C, and U respectively; Af, Gf, Cf and Uf are 2'-fluoro A, G, C and U respectively; wherein G2p is guanosine-2'-phosphate, s is a phosphorothioate linkage, and wherein the 3'-end of the sense strand is conjugated to the ligand as shown in the following schematic:

1, 2, or 3 nucleotides from the nucleotide sequence of 5'-AACCAGAAGAAGCAGGUGA-3' (SEQ ID NO: 1790).

In one embodiment, the antisense strand comprises or consists of the nucleotide sequence of 5'-AACCAGAAGAAGCAGGUGA-3' (SEQ ID NO: 1790).

In one embodiment, the sense strand comprises the nucleotide sequence of 5'-UCACCUGCUUCUUCUGGUU-3'(SEQ ID NO: 1686) and the antisense strand comprises the nucleotide sequence of 5'-AACCAGAAGAAGCAGGUGA-3' (SEQ ID NO:1790).

In one embodiment, the sense strand differs by no more than 3, e.g., 0, 1, 2, or 3, modified nucleotides from the nucleotide sequence of 5'-UfcAfcCfuGfcUfuCfuUfcUfgGfsusUf-3' (SEQ ID NO: 1974) wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

In one embodiment, the antisense strand differs by no more than 3, e.g., 0, 1, 2, or 3, modified nucleotides from the nucleotide sequence of 5'-asAfscCfaGfaAfgAfaGfcAfgGfusGfsa-3' (SEQ ID NO: 2203), wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

In one embodiment, the sense strand comprises the nucleotide sequence of 5'-UfcAfcCfuGfcUfuCfuUfcUfgGfsusUf-3' (SEQ ID NO: 1974) and the antisense strand comprises the nucleotide sequence of 5'-asAfscCfaGfaAfgAfaGfcAfgGfusGfsa-3' (SEQ ID NO: 2203), wherein a, g, c and u are 2'-O-methyl (2'-OMe) A, G, C, and U respectively; Af, Gf, Cf and Uf are 2'-fluoro A, G, C and U respectively; and s is a phosphorothioate linkage.

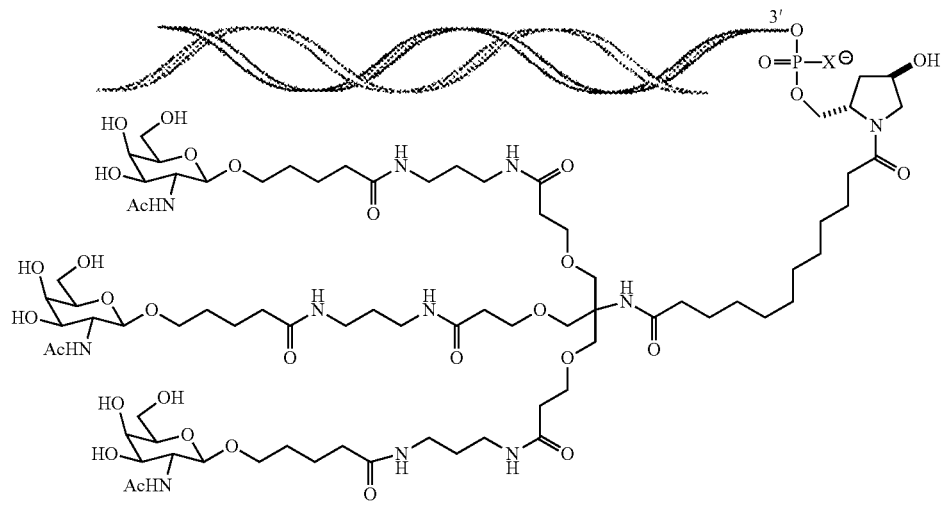

and, wherein X is O.

In one embodiment, the sense strand comprises at least 17 contiguous nucleotides differing by no more than 0, 1, 2, or 3 nucleotides from the nucleotide sequence of 5'-UCACCUGCUUCUUCUGGUU-3'(SEQ ID NO: 1686).

In one embodiment, the sense strand comprises or consists of the nucleotide sequence of 5'-UCACCUGCUUCUUCUGGUU-3'(SEQ ID NO: 1686).

In one embodiment, the antisense strand comprises at least 17 contiguous nucleotides differing by no more than 0, In one embodiment, the sense strand comprises the nucleotide sequence of 5'-Q191sUfcAfcCfuGfcUfuCfuUfcUfgGfsusUf-3' (SEQ ID NO: 2332) and the antisense strand comprises the nucleotide sequence of 5'-asAfscCfaGfaAfgAfaGfcAfgGfusGfsa-3' (SEQ ID NO: 2203), wherein a, g, c and u are 2'-O-methyl (2'-OMe) A, G, C, and U respectively; Af, Gf, Cf and Uf are 2'-fluoro A, G, C and U respectively; s is a phosphorothioate linkage, and Q191 is N-[tris(GalNAc-alkyl)-amidododecanoyl]-(S)-pyrrolidin-3-ol-phosphorothioate (p-C12-(GalNAc-alkyl)3).

In one embodiment, the sense strand comprises the nucleotide sequence of 5'-UfcAfcCfuGfcUfuCfuUf-cUfgGfsusUf-3' (SEQ ID NO: 1974) and the antisense strand comprises the nucleotide sequence of 5'-asAfscCf-aGfaAfgAfaAfgAfaGfcAfgGfusGfsa-3' (SEQ ID NO: 2203), wherein a, g, c and u are 2'-O-methyl (2'-OMe) A, G, C, and U respectively; Af, Gf, Cf and Uf are 2'-fluoro A, G, C and U respectively; and s is a phosphorothioate linkage, wherein the 5'-end of the sense strand is conjugated to the ligand as shown in the following schematic:

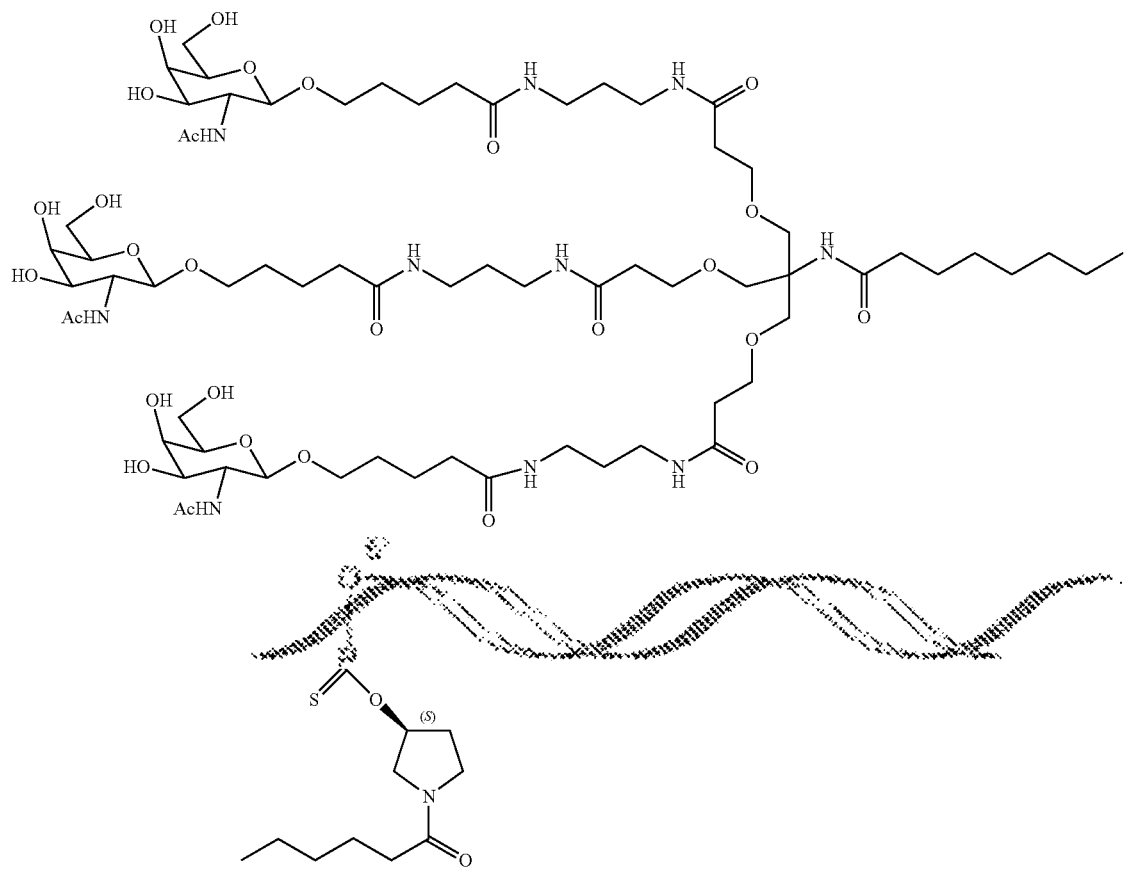

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a Transmembrane protease, serine 6 (TMPRSS6) gene in a cell. The method includes contacting the cell with any of the dsRNAs of the invention or any of the pharmaceutical compositions of the invention, thereby inhibiting expression of the TMPRSS6 gene in the cell.

In one embodiment, the cell is within a subject, e.g., a human subject, e.g., a subject having a Transmembrane protease, serine 6 (TMPRSS6)-associated disorder, such as a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

In some embodiments, the TMPRSS6-associated disorder is β-thalassemia. In one embodiment, the TMPRSS6-asso- In another embodiment, the RNAi agent is a pharmaceutically acceptable salt thereof. "Pharmaceutically acceptable salts" of each of RNAi agents herein include, but are not limited to, a sodium salt, a calcium salt, a lithium salt, a potassium salt, an ammonium salt, a magnesium salt, an mixtures thereof. One skilled in the art will appreciate that the RNAi agent, when provided as a polycationic salt having one cation per free acid group of the optionally modified phosophodiester backbone and/or any other acidic modifications (e.g., 5'-terminal phosphonate groups). For example, an oligonucleotide of "n" nucleotides in length contains n−1 optionally modified phosophodiesters, so that an oligonucleotide of 21 nt in length may be provided as a salt having up to 20 cations (e.g, 20 sodium cations). Similarly, an RNAi agents having a sense strand of 21 nt in length and an antisense strand of 23 nt in length may be provided as a salt having up to 42 cations (e.g., 42 sodium cations). In the preceding example, where the RNAi agent also includes a 5'-terminal phosphate or a 5'-terminal vinylphosphonate group, the RNAi agent may be provided as a salt having up to 44 cations (e.g., 44 sodium cations).

ciated disorder is β-thalassemia major. In another embodiment, the TMPRSS6-associated disorder is β-thalassemia intermedia. In some embodiments, the TMPRSS6-associated disorder is polycythemia vera.

In certain embodiments, the TMPRSS6 expression is inhibited by at least about 30%, 40%, 50%, 60%, 70%, 80%, 90%, or 95%. In one embodiment, inhibiting expression of TMPRSS6 decreases TMPRSS6 protein level in serum of the subject by at least 30%, 40%, 50%, 60%, 70%, 80%, 90%, or 95%.

In certain embodiments, contacting the cell with the dsRNA agent increases the expression of hepcidin by at least 50%, 60%, 70%, 80%, 90%, or 95%. In one embodiment, increasing expression of hepicidin increases hepicidin protein level in serum of the subject by at least 50%, 60%, 70%, 80%, 90%, or 95%.

In one aspect, the present invention provides a method of treating a subject having a disorder that would benefit from reduction in Transmembrane protease, serine 6 (TMPRSS6) expression. The method includes administering to the subject a therapeutically effective amount of any of the dsRNAs of the invention or any of the pharmaceutical compositions of the invention, thereby treating the subject having the disorder that would benefit from reduction in TMPRSS6 expression.

In another aspect, the present invention provides a method of preventing at least one symptom in a subject having a disorder that would benefit from reduction in Transmembrane protease, serine 6 (TMPRSS6) expression. The method includes administering to the subject a prophylactically effective amount of any of the dsRNAs of the invention or any of the pharmaceutical compositions of the invention, thereby preventing at least one symptom in the subject having the disorder that would benefit from reduction in TMPRSS6 expression.

In certain embodiments, the disorder is a Transmembrane protease, serine 6 (TMPRSS6)-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

In some embodiments, the TMPRSS6-associated disorder is β-thalassemia. In one embodiment, the TMPRSS6-associated disorder is β-thalassemia major. In another embodiment, the TMPRSS6-associated disorder is β-thalassemia intermedia. In some embodiments, the TMPRSS6-associated disorder is polycythemia vera.

In certain embodiments, administration of the dsRNA to the subject causes a decrease in the iron level, ferritin level and/or transferrin saturation level and/or a decrease in TMPRSS6 protein accumulation in the subject. In some embodiments, administration of the dsRNA to the subject causes an increase in the hemoglobin level and/or the hematocrit level in the subject.

In a further aspect, the present invention also provides methods of inhibiting the expression of TMPRSS6 in a subject. The methods include administering to the subject a therapeutically effective amount of any of the dsRNAs provided herein, thereby inhibiting the expression of TMPRSS6 in the subject.

In one embodiment, the subject is human.

In one embodiment, the dsRNA agent is administered to the subject at a dose of about 0.01 mg/kg to about 50 mg/kg.

In one embodiment, the dsRNA agent is administered to the subject subcutaneously or intravenously.

In one embodiment, the methods of the invention include further determining the level of TMPRSS6 in a sample(s) from the subject.

In one embodiment, the level of TMPRSS6 in the subject sample(s) is a TMPRSS6 protein level in a blood, serum or liver sample(s).

In one embodiment, the methods of the invention include further determining the level of iron and/or hepcidin in a sample(s) from the subject.

In certain embodiments, the methods of the invention further comprise administering to the subject an additional therapeutic agent. In one embodiment, the methods of the invention further comprise administering an iron chelator, e.g., deferiprone, deferoxamine, and deferasirox, to a subject.

The present invention also provides kits comprising any of the dsRNAs of the invention or any of the pharmaceutical compositions of the invention, and optionally, instructions for use. In one embodiment, the invention provides a kit for performing a method of inhibiting expression of TMPRSS6 gene in a cell by contacting a cell with a double stranded RNAi agent of the invention in an amount effective to inhibit expression of the TMPRSS6 in the cell. The kit comprises an RNAi agent and instructions for use and, optionally, means for administering the RNAi agent to a subject.

The present invention also provide an RNA-induced silencing complex (RISC) comprising an antisense strand of any of the dsRNA agents of the present invention.

DETAILED DESCRIPTION OF THE INVENTION

Figure 1:
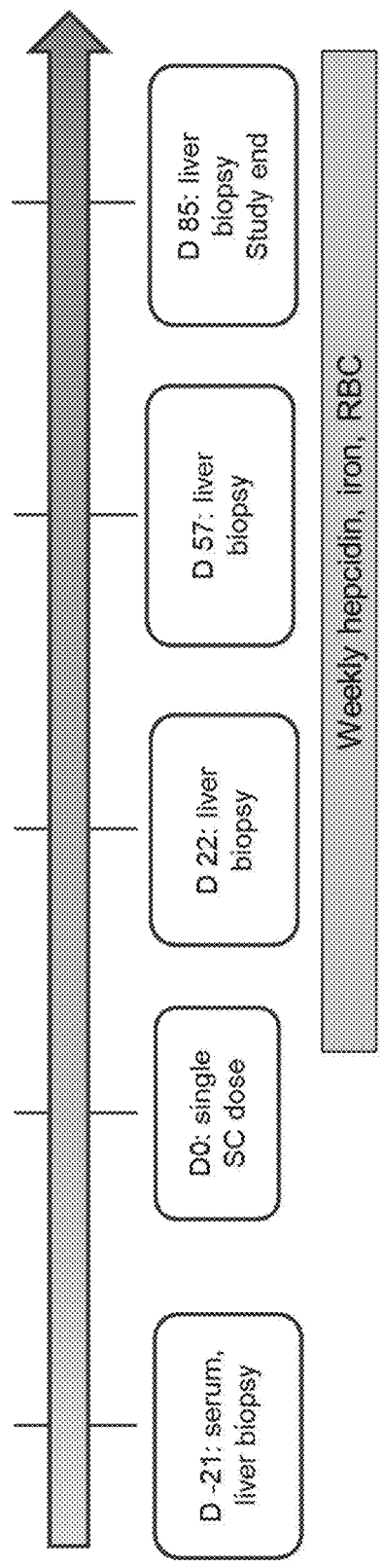
FIG. 1 is a schematic depicting the study plan to determine the efficacy of the dsRNA agents disclosed herein in vivo in Cynomolgus monkeys.

The present invention provides iRNA compositions which effect the RNA-induced silencing complex (RISC)-mediated cleavage of RNA transcripts of a Transmembrane protease, serine 6 (TMPRSS6) gene. The gene may be within a cell, e.g., a cell within a subject, such as a human. The use of these iRNAs enables the targeted degradation of mRNAs of the corresponding gene (TMPRSS6) in mammals.

The iRNAs of the invention have been designed to target the human Transmembrane protease, serine 6 (TMPRSS6) gene, including portions of the gene that are conserved in the TMPRSS6 orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a Transmembrane protease, serine 6 (TMPRSS6)-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, using iRNA compositions which effect the RNA-induced silencing complex (RISC)-mediated cleavage of RNA transcripts of a TMPRSS6 gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a TMPRSS6 gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a TMPRSS6 gene. In some embodiments, such iRNA agents having longer length antisense strands may, for example, include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (TMPRSS6 gene) in mammals Using in vitro assays, the present inventors have demonstrated that iRNAs targeting a TMPRSS6 gene can potently mediate RNAi, resulting in significant inhibition of expression of a TMPRSS6 gene. Thus, methods and compositions including these iRNAs are useful for treating a subject having a TMPRSS6-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

Accordingly, the present invention provides methods and combination therapies for treating a subject having a disorder that would benefit from inhibiting or reducing the expression of a TMPRSS6 gene, e.g., a Transmembrane protease, serine 6 (TMPRSS6)-associated disease, such as a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, using iRNA compositions which effect the RNA-induced silencing complex (RISC)-mediated cleavage of RNA transcripts of a TMPRSS6 gene.

The present invention also provides methods for preventing at least one symptom in a subject having a disorder that would benefit from inhibiting or reducing the expression of a TMPRSS6 gene, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

The following detailed description discloses how to make and use compositions containing iRNAs to inhibit the expression of a TMPRSS6 gene as well as compositions, uses, and methods for treating subjects that would benefit from inhibition and/or reduction of the expression of a TMPRSS6 gene, e.g., subjects susceptible to or diagnosed with a TMPRSS6-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means+10%. In certain embodiments, about means+5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, "Transmembrane protease, serine 6," used interchangeably with the term "TMPRSS6," refers to the type II plasma membrane serine protease (TTSP) gene or protein. TMPRSS6 is also known as matriptase-2, IRIDA (iron refractory iron-deficiency anemia), transmembrane protease serine 6, type II transmembrane serine protease 6, and membrane-bound mosaic serine proteinase matriptase-2. TMPRSS6 is a serine protease Type II transmembrane protein of approximately 899 amino acids in length. TMPRSS6 contains multiple domains, e.g., a short endo domain, a transmembrane domain, a sea urchin sperm protein/enteropeptidase domain/agrin (SEA) domain, two complement factor/urchin embryonic growth factor/BMP domains (CUB), three LDL-R class a domains (LDLa), and a trypsin-like serine protease domain with conserved His-Asp-Ser triad (HDS).

The sequence of a human TMPRSS6 mRNA transcript can be found at, for example, GenBank Accession No. GI: 1755203660 (NM_153609.4; SEQ ID NO:1; reverse complement, SEQ ID NO: 2). The sequence of mouse TMPRSS6 mRNA can be found at, for example, GenBank Accession No. GI: 125656151 (NM_027902.2; SEQ ID NO:3; reverse complement, SEQ ID NO: 4). The sequence of rat TMPRSS6 mRNA can be found at, for example, GenBank Accession No. GI: 194474097 (NM_001130556.1; SEQ ID NO:5; reverse complement, SEQ ID NO: 6). The sequence of Macaca fascicularis TMPRSS6 mRNA can be found at, for example, GenBank Accession No. GI: 982272225 (XM_005567384.2; SEQ ID NO: 7; reverse complement, SEQ ID NO: 8). The sequence of Macaca mulatta TMPRSS6 mRNA can be found at, for example, GenBank Accession No. GI: 1622838152 (XM_015150283.2; SEQ ID NO: 9; reverse complement, SEQ ID NO: 10).

Additional examples of TMPRSS6 mRNA sequences are readily available through publicly available databases, e.g., GenBank, UniProt, OMIM, and the Macaca genome project web site.

Further information on TMPRSS6 can be found, for example, at www.ncbi.nlm.nih.gov/gene/?term=TMPRSS6.

The entire contents of each of the foregoing GenBank Accession numbers and the Gene database numbers are incorporated herein by reference as of the date of filing this application.

The term TMPRSS6, as used herein, also refers to variations of the TMPRSS6 gene including variants provided in the SNP database. Numerous seuqnce variations within the TMPRSS6 gene have been identified and may be found at, for example, NCBI dbSNP and UniProt (see, e.g., www.ncbi.nlm.nih.gov/snp/?term=TMPRSS6, the entire contents of which is incorporated herein by reference as of the date of filing this application.

As used herein, "target sequence" refers to a contiguous portion of the nucleotide sequence of an mRNA molecule formed during the transcription of a TMPRSS6 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a TMPRSS6 gene.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a TMPRSS6 gene in a cell, e.g., a cell within a subject, such as a mammalian subject.

In one embodiment, an RNAi agent of the invention includes a single stranded RNA that interacts with a target RNA sequence, e.g., a TMPRSS6 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a TMPRSS6 gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a TMPRSS6 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., a TMPRSS6 gene, to direct cleavage of the target RNA.

In some embodiments, an iRNA of the invention is a dsRNA of 24-30 nucleotides that interacts with a target RNA sequence, e.g., a TMPRSS6 target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., a TMPRSS6 mRNA.

As used herein, the term "region of complementarity" refers to the region on the antisense strand that is substantially complementary to a sequence, for example a target sequence, e.g., a TMPRSS6 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a TMPRSS6 gene, generally does not contain any mismatch within the central 13 nucleotides. The methods described herein or methods known in the art can be used to determine whether an RNAi agent containing a mismatch to a target sequence is effective in inhibiting the expression of a TMPRSS6 gene. Consideration of the efficacy of RNAi agents with mismatches in inhibiting expression of a TMPRSS6 gene is important, especially if the particular region of complementarity in a TMPRSS6 gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a TMPRSS6 gene). For example, a polynucleotide is complementary to at least a part of a TMPRSS6 mRNA if the sequence is substantially complementary to a non-interrupted portion of an mRNA encoding a TMPRSS6 gene.

Accordingly, in some embodiments, the antisense polynucleotides disclosed herein are fully complementary to the target TMPRSS6 sequence. In other embodiments, the antisense polynucleotides disclosed herein are substantially complementary to the target TMPRSS6 sequence and comprise a contiguous nucleotide sequence which is at least 80% complementary over its entire length to the equivalent region of the nucleotide sequence of any one of SEQ ID NOs:1, 3, 5, 7, or 9, or a fragment of any one of SEQ ID NOs:1, 3, 5, 7, or 9, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target TMPRSS6 sequence and comprise a contiguous nucleotide sequence which is at least 80% complementary over its entire length to a fragment of SEQ ID NO: 1 selected from the group of nucleotides 187-210; 227-254; 322-363; 362-390; 398-420; 404-429; 410-435; 439-461; 443-467; 448-474; 460-483; 466-488; 496-519; 519-542; 526-548; 557-593; 641-671; 652-676; 687-713; 725-762; 757-794; 886-908; 921-951; 956-987; 1051-1082; 1233-1269; 1279-1313; 1313-1341; 1327-1351; 1415-1439; 1447-1480; 1464-1486; 1486-1509; 1559-1589; 1571-1595; 1579-1609; 1707-1735; 1738-1764; 1806-1828; 1864-1886; 1934-1966; 1967-1991; 2008-2031; 2015-2043; 2042-2072; 2287-2311; 2297-2354; 2336-2361; 2360-2384; 2416-2438; 2481-2510; 2496-2527; 2526-2558; 2665-2693; 2693-2719; 2707-2729; 2799-2821; 2851-2874; 2971-2999; 2981-3006; and 3155-3195 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target TMPRSS6 sequence and comprise a contiguous nucleotide sequence which is at least 80% complementary over its entire length to a fragment of SEQ ID NO: 1 selected from the group of nucleotides 230-252, 324-346, 560-578, 560-582, 2338-2360, 3163-3185, 3169-3191, and 3172-3194 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target TMPRSS6 sequence and comprise a contiguous nucleotide sequence which is at least 80% complementary over its entire length to a fragment of SEQ ID NO: 1 selected from the group of nucleotides 560-578, 2338-2360, and 3169-3191 of SEQ ID NO: 1, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target TMPRSS6 sequence and comprise a contiguous nucleotide sequence which is at least about 80% complementary over its entire length to any one of the sense strand nucleotide sequences in any one of any one of Tables 2-7, or a fragment of any one of the sense strand nucleotide sequences in any one of Tables 2-7, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target TMPRSS6 sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, or 10, or a fragment of any one of SEQ ID NOs:2, 4, 6, 8, or 10, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target TMPRSS6 sequence, and wherein the sense strand polynucleotide comprises a contiguous nucleotide sequence which is at least about 80% complementary over its entire length to any one of the antisense strand nucleotide sequences in any one of any one of Tables 2-7, or a fragment of any one of the antisense strand nucleotide sequences in any one of Tables 2-7, such as about 85%, about 90%, about 91%, about 92%, about 93%, about 94%, about 95%, about 96%, about 97%, about 98%, about 99%, or 100% complementary.

In certain embodiments, the sense and antisense strands are selected from any one of duplexes AD-1556360, AD-1571158, AD-1571033, AD-1554875, AD-1571160, AD-1555117, AD-1554911, and AD-1556915.

In certain embodiments, the sense and antisense strands are selected from any one of duplexes AD-1556360, AD-1571158, and AD-1571033.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858, 225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In an embodiment, the subject is a human, such as a human being treated or assessed for a disease or disorder that would benefit from reduction in TMPRSS6 expression; a human at risk for a disease or disorder that would benefit from reduction in TMPRSS6 expression; a human having a disease or disorder that would benefit from reduction in TMPRSS6 expression; or human being treated for a disease or disorder that would benefit from reduction in TMPRSS6 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of a TMPRSS6-associated disorder in a subject. Treatment also includes a reduction of one or more sign or symptoms associated with unwanted TMPRSS6 expression; diminishing the extent of unwanted TMPRSS6 activation or stabilization; amelioration or palliation of unwanted TMPRSS6 activation or stabilization. "Treatment" can also mean prolonging survival as compared to expected survival in the absence of treatment. The term "lower" in the context of the level of TMPRSS6 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of TMPRSS6 in a subject is a decrease to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder or condition thereof, may be treated or ameliorated by a reduction in expression of a TMPRSS6 gene, refers to a reduction in the likelihood that a subject will develop a symptom associated with such a disease, disorder, or condition, e.g., a symptom of unwanted or excessive TMPRSS6 expression, such as elevated iron levels or iron dyregulation. The likelihood of developing elevated iron levels or iron dyregulation is reduced, for example, when an individual having one or more risk factors for elevated iron levels or iron dyregulation either fails to develop elevated iron levels or iron dyregulation, or develops elevated iron levels or iron dyregulation with less severity relative to a population having the same risk factors and not receiving treatment as described herein. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "Transmembrane protease, serine 6-associated disease" or "TMPRSS6-associated disease," is a disease or disorder that is caused by, or associated with TMPRSS6 gene expression or TMPRSS6 protein production. The term "TMPRSS6-associated disease" includes a disease, disorder or condition that would benefit from a decrease in TMPRSS6 gene expression, replication, or protein activity.

In some embodiments, the TMPRSS6-associated disease is a disorder associated with iron overload, a condition characterized by elevated iron levels, or iron dysregulation. Iron overload may be caused, for example, by hereditary conditions, by elevated iron uptake from diet, or by excess iron administered parenterally that includes intravenous injection of excess iron, and transfusional iron overload.

In some embodiments, the TMPRSS6-associated disease is a disorder of ineffective erythropoiesis. Ineffective erythropoiesis is an abnormal expansion of the number of erythroid progenitor cells with unproductive synthesis of enucleated erythrocytes, leading to anemia and hypoxia. In particular, an increase in erythroid cells fails to produce a corresponding increase in red blood cells. As a consequence, iron absorption is still increased in response to stress, but the iron is deposited in the organs rather than being used to generate more erythrocytes.

In some embodiments, TMPRSS6-associated disorders include, but are not limited to, hereditary hemochromatosis, idiopathic hemochromatosis, primary hemochromatosis, secondary hemochromatosis, severe juvenile hemochromatosis, neonatal hemochromatosis, sideroblastic anemia, hemolytic anemia, dyserythropoietic anemia, sickle-cell anemia, hemoglobinopathy, thalassemia (e.g., β-thalassemia and α-thalassemia), polycythemia vera, myelodysplastic syndrome, congenital dyserythropoietic anemias, pyruvate kinase deficiency, chronic liver diseases, porphyria cutanea tarda, erythropoietic porphyria, atransferrinemia, hereditary tyrosinemia, cerebrohepatorenal syndrome, idiopathic pulmonary hemosiderosis, renal hemosiderosis.

In some embodiments, TMPRSS6 associated disorders include disorders associated with oral administration of excess iron, transfusional iron overload and intravenous injection of excess iron.

In other embodiments, TMPRSS6-associated disorders also include disorders with symptoms that are associated with or may be caused by iron overload. Such symptoms include increased risk for liver disease (cirrhosis, cancer), heart attack or heart failure, diabetes mellitus, osteoarthritis, osteoporosis, metabolic syndrome, hypothyroidism, hypogonadism, and in some cases premature death. In one embodiment, TMPRSS6-associated disorders include neurodegenerative disorders associated with iron overload and/or iron dysregulation, such as Alzheimer's Disease, Parkinson's Disease, Huntington's Disease, Friedreich's Ataxia, epilepsy and multiple sclerosis. Administration of an iRNA that targets TMPRSS6, e.g., an iRNA described in any one of Tables 2-7 can treat one or more of these symptoms, or prevent the development or progression of a disease or disorder that is aggravated by increased iron levels.

In one embodiment, a TMPRSS6-associated disorder is a β-thalassemia. A β-thalassemia is any one of a group of hereditary disorders characterized by a genetic deficiency in the synthesis of beta-globin chains. In the homozygous state, beta thalassemia ("thalassemia major") causes severe, transfusion-dependent anemia. In the heterozygous state, the beta thalassemia trait ("thalassemia minor") causes mild to moderate microcytic anemia. "Thalassemia intermedia" is a β-thalassemia that results in subjects in whom the clinical severity of the disease is somewhere between the mild symptoms of β-thalassemia minor and the β-thalassemia major. Several laboratory tests may be used to help detect and diagnose thalassemia, for example, a complete blood count to determine the number of red blood cells and the number of hemoglobin, blood smear test, hemoglobin electrophoresis, gene sequencing, or iron tests to examine the level of iron, ferritin, unstaturated iron binding capacity, total iron binding capacity, or the transferrin saturation level. The type and relative amounts of hemoglobin present in red blood cells are another indicator for thalassemia. β-thalassemia upsets the balance of beta and alpha hemoglobin chain formation and causes an increase in minor hemoglobin components. So individuals with the β-thalassemia major usually have larger percentages of Hb F. Those with β-thalassemia minor usually have elevated fraction of Hb A2.

In one embodiment, a β-thalassemia is thalassemia major. In another embodiment, a β-thalassemia is thalassemia intermedia.

In some embodiments, the TMPRSS6-associated disorder is polycythemia vera. Polycythemia vera is a type of blood cancer which causes the bone marrow to make excess red blood cells. These excess cells usually thinken the blood vessels, which make the patients more prone to develop blood clots, and other complications such as stroke or heart attack. Several tests may be performed to help detect and diagnose polycythemia vera, for example, a complete blood count, blood smear test, erythropoietin level test, bone marrow aspiration or biopsy, or gene sequencing.

"Therapeutically effective amount," as used herein, is intended to include the amount of an RNAi agent that, when administered to a subject having a TMPRSS6-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having a TMPRSS6-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials (including salts), compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a TMPRSS6 gene. In certain embodiments, the iRNA includes double stranded ribonucleic acid (dsRNA) molecules for inhibiting the expression of a TMPRSS6 gene in a cell, such as a cell within a subject, e.g., a mammal, such as a human susceptible to developing a TMPRSS6-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia. The dsRNAi agent includes an antisense strand having a region of complementarity which is complementary to at least a part of an mRNA formed in the expression of a TMPRSS6 gene. The region of complementarity is about 19-30 nucleotides in length (e.g., about 30, 29, 28, 27, 26, 25, 24, 23, 22, 21, 20, or 19 nucleotides in length).

Upon contact with a cell expressing the TMPRSS6 gene, the iRNA inhibits the expression of the TMPRSS6 gene (e.g., a human, a primate, a non-primate, or a rat TMPRSS6 gene) by at least about 50% as assayed by, for example, a PCR or branched DNA (bDNA)-based method, or by a protein-based method, such as by immunofluorescence analysis, using, for example, western blotting or flow cytometric techniques. In certain embodiments, inhibition of expression is determined by the qPCR method provided in the examples herein with the siRNA at, e.g., a 10 nM concentration, in an appropriate organism cell line provided therein. In certain embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a TMPRSS6 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target TMPRSS6 gene expression is not generated in the target cell by cleavage of a larger dsRNA.

A dsRNA as described herein can further include one or more single-stranded nucleotide overhangs, e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2-7, and the corresponding antisense strand of the sense strand is selected from the group of sequences of any one of Tables 2-7. In this aspect, one of the two sequences is complementary to the other of the two sequences, with one of the sequences being substantially complementary to a sequence of an mRNA generated in the expression of a TMPRSS6 gene. As such, in this aspect, a dsRNA will include two oligonucleotides, where one oligonucleotide is described as the sense strand in any one of Tables 2-7, and the second oligonucleotide is described as the corresponding antisense strand of the sense strand in any one of Tables 2-7.

In certain embodiments, the substantially complementary sequences of the dsRNA are contained on separate oligonucleotides. In other embodiments, the substantially complementary sequences of the dsRNA are contained on a single oligonucleotide.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences in any one of Tables 2-7.

It will be understood that, although the sequences in, for example, Tables 3 or 5, are not described as modified or conjugated sequences, the RNA of the iRNA of the invention e.g., a dsRNA of the invention, may comprise any one of the sequences set forth in any one of Tables 2-7 that is un-modified, un-conjugated, or modified or conjugated differently than described therein. In other words, the invention encompasses dsRNA of Tables 2-7 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-7. dsRNAs described herein can include at least one strand of a length of minimally 21 nucleotides. It can be reasonably expected that shorter duplexes having any one of the sequences in any one of Tables 2-7 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-7, and differing in their ability to inhibit the expression of a TMPRSS6 gene by not more than about 5, 10, 15, 20, 25, or 30% inhibition from a dsRNA comprising the full sequence, are contemplated to be within the scope of the present invention.

In addition, the RNAs provided in Tables 2-7 identify a site(s) in a TMPRSS6 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-7 coupled to additional nucleotide sequences taken from the region contiguous to the selected sequence in a TMPRSS6 gene.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. Patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. Patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —CH$_2$—NH—CH$_2$—, —CH$_2$—N(CH$_3$)—O—CH$_2$-[known as a methylene (methylimino) or MMI backbone], —CH$_2$—O—N(CH$_3$)—CH$_2$—, —CH$_2$—N(CH$_3$)—N(CH$_3$)—CH$_2$— and —N(CH$_3$)—CH$_2$—CH$_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—OCH$_2$—.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[(CH$_2$)$_n$O]$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_3$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. Patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In some embodiments, an RNAi agent of the disclosure can also be modified to include one or more bicyclic sugar moieties. A "bicyclic sugar" is a furanosyl ring modified by a ring formed by the bridging of two carbons, whether adjacent or non-adjacent. A "bicyclic nucleoside" ("BNA") is a nucleoside having a sugar moiety comprising a ring formed by bridging two carbons, whether adjacent or non-adjacent, of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

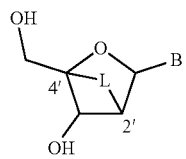

wherein B is a nucleobase or modified nucleobase and L is the linking group that joins the 2'-carbon to the 4'-carbon of the ribose ring. Examples of such 4' to 2' bridged bicyclic nucleosides, include but are not limited to 4'-($CH_2$)—O-2' (LNA); 4'-($CH_2$)—S-2'; 4'-($CH_2$)$_2$—O-2' (ENA); 4'-CH($CH_3$)—O-2' (also referred to as "constrained ethyl" or "cEt") and 4'-CH($CH_2OCH_3$)—O-2' (and analogs thereof; see, e.g., U.S. Pat. No. 7,399,845); 4'-C($CH_3$)($CH_3$)—O-2' (and analogs thereof; see e.g., U.S. Pat. No. 8,278,283); 4'-$CH_2$—N($OCH_3$)-2' (and analogs thereof; see e.g., U.S. Pat. No. 8,278,425); 4'-$CH_2$—O—N($CH_3$)-2' (see, e.g., U.S. Patent Publication No. 2004/0171570); 4'-$CH_2$—N(R)—O—2', wherein R is H, C1-C12 alkyl, or a nitrogen protecting group (see, e.g., U.S. Pat. No. 7,427,672); 4'-$CH_2$—C(H)($CH_3$)-2' (see, e.g., Chattopadhyaya et al., *J. Org. Chem.,* 2009, 74, 118-134); and 4'-$CH_2$—C(=$CH_2$)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH($CH_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3'-phosphate, inverted 2'-deoxy-modified ribonucleotide, such as inverted dT(idT), inverted dA (idA), and inverted abasic 2'-deoxyribonucleotide (iAb) and others. Disclosure of this modification can be found in WO 2011/005861.

In one example, the 3' or 5' terminal end of a oligonucleotide is linked to an inverted 2'-deoxy-modified ribonucleotide, such as inverted dT(idT), inverted dA (idA), or a inverted abasic 2'-deoxyribonucleotide (iAb). In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-end of a sense strand is linked via a 3'-3'-phosphorothioate linkage to an inverted abasic ribonucleotide (iAb). In another example, the 3'-end of a sense strand is linked via a 3'-3'-phosphorothioate linkage to an inverted dA (idA).

In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-terminal nucleotides of a sense strand is an inverted dA (idA) and is linked to the preceding nucleotide via a 3'-3'-linkage (e.g., 3'-3'-phosphorothioate linkage).

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., TMPRSS6 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (i.e., the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, and 13 from the 5'end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5'end. The antisense strand contains at least one motif of three 2'-O-methyl modifications on three consecutive nucleotides at positions 11, 12, and 13 from the 5'end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-0-methyl modifications on three consecutive nucleotides at positions 11, 12, and 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5'end; the antisense strand contains at least one motif of three 2'-0-methyl modifications on three consecutive nucleotides at positions 11, 12, and 13 from the 5'end, wherein one end of the RNAi agent is blunt, while the other end comprises a 2 nucleotide overhang. In one embodiment, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (such as, GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modifecation on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and
XXX, YYY, and ZZZ each independently represent one motif of three identical modifications on three consecutive nucleotides. In one embodiment, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

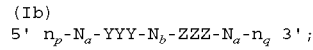

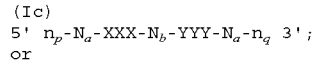

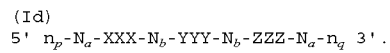

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In one embodiment, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

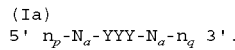

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

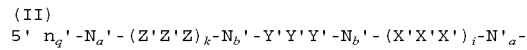

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;

wherein $N_b'$ and Y' do not have the same modification; and
X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In one embodiment, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

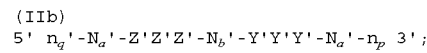

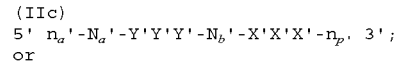

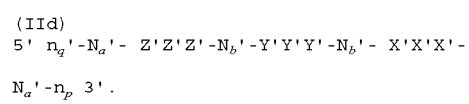

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIC), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In one embodiment, $N_b$ is 0, 1, 2, 3, 4, 5, or 6.

In other embodiments, k is 0 and l is 0 and the antisense strand may be represented by the formula:

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

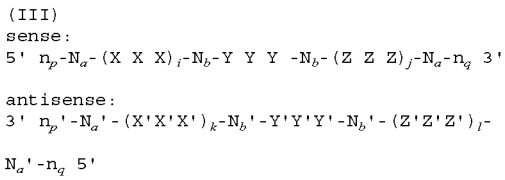

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

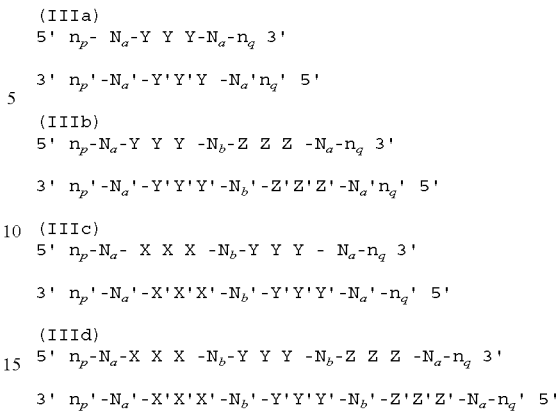

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5' vinyl phosphonate modified nucleotide of the disclosure has the structure:

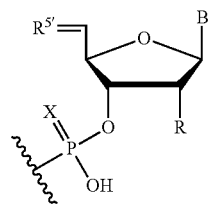

wherein X is O or S;
R is hydrogen, hydroxy, fluoro, or $C_{1-20}$alkoxy (e.g., methoxy or n-hexadecyloxy);
$R^{5'}$ is =C(H)—P(O)(OH)$_2$ and the double bond between the C5' carbon and $R^{5'}$ is in the E or Z orientation (e.g., E orientation); and
B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In one embodiment, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In one embodiment, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand or at positions 2-8 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature ($T_m$) than the $T_m$ of the dsRNA without having such modification(s). For example, the thermally destabilizing modification(s) can decrease the $T_m$ of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

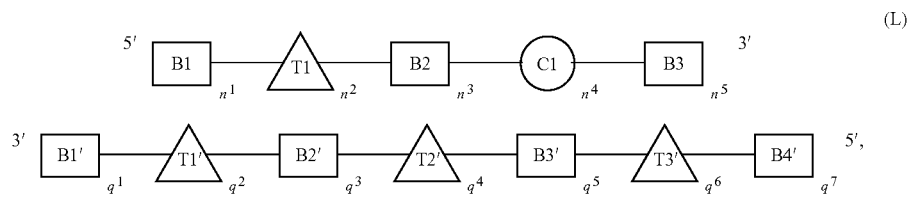

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O—NMA, 2'O—CH2C(O)N(Me)H) modification.

C1 is a thermally destabilizing nucleotide placed at a site opposite to the seed region of the antisense strand (i.e., at positions 2-8 of the 5'-end of the antisense strand, or at positions 2-9 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA), or 2'-5'-linked ribonucleotides ("3'-RNA"). In one embodiment, C1 has thermally destabilizing modification selected from the group consisting of: i) mismatch with the opposing nucleotide in the antisense strand; ii) abasic modification selected from the group consisting of:

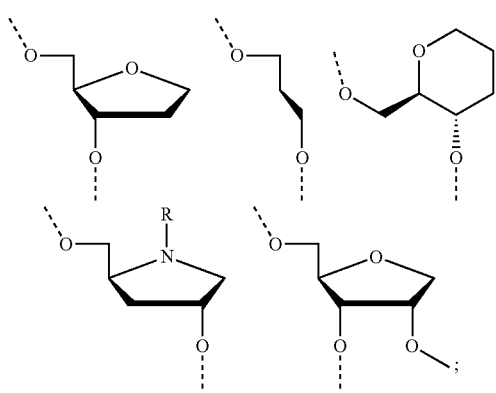

is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

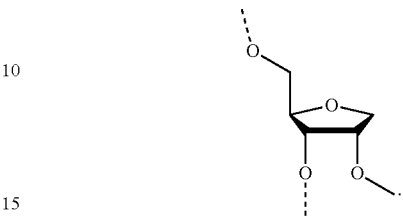

and iii) sugar modification selected from the group consisting of:

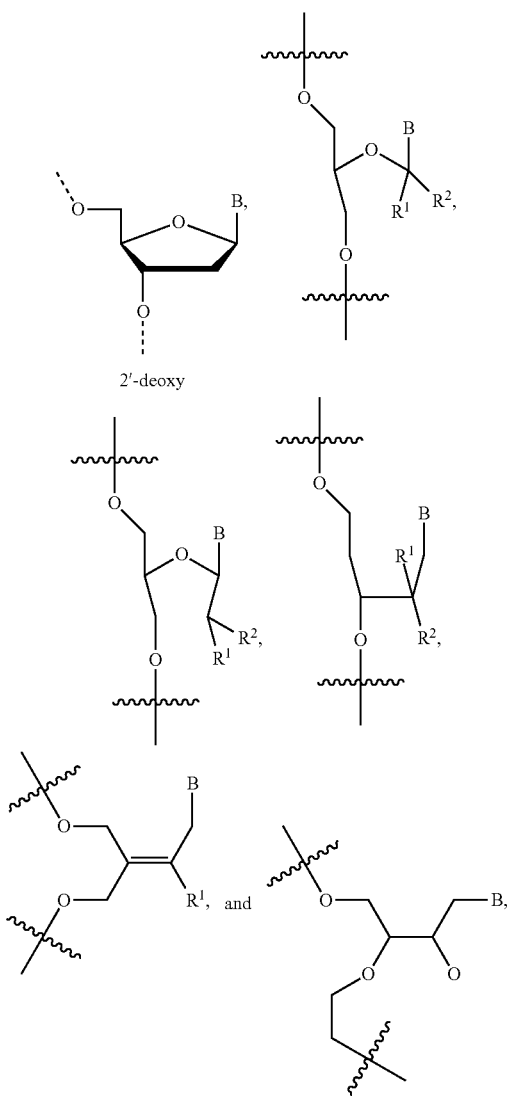

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, Ti is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, Ti is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose. In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos), or 5'-deoxy-5'-C-malonyl

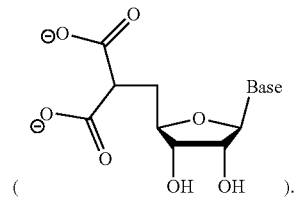

When the 5'-end phosphorus-containing group is 5'-end vinylphosphonate (5'-VP), the 5'-VP can be either 5'-E-VP isomer (i.e., trans-vinylphosphonate,

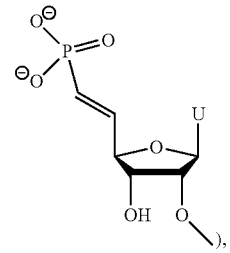

5'-Z-VP isomer (i.e., cis-vinylphosphonate,

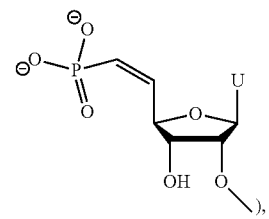

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-PS$_2$. In one embodiment, the RNAi agent comprises a 5'-PS$_2$ in the antisense strand.

In one embodiment, the RNAi agent comprises a 5'-PS$_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In one embodiment, the 5'-$PS_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker; and
    (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
  and
  (b) an antisense strand having:
    (i) a length of 23 nucleotides;
    (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
    (iii) phosphorothioate internucleotide linkages between nucleotide positions 21 and 22, and between nucleotide positions 22 and 23 (counting from the 5' end);
  wherein the dsRNA agents have a two nucleotide overhang at the 3'-end of the antisense strand, and a blunt end at the 5'-end of the antisense strand.

In another particular embodiment, an RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker;
    (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
    (iv) phosphorothioate internucleotide linkages between nucleotide positions 1 and 2, and between nucleotide positions 2 and 3 (counting from the 5' end);
  and
  (b) an antisense strand having:
    (i) a length of 23 nucleotides;
    (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
    (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
  wherein the RNAi agents have a two nucleotide overhang at the 3'-end of the antisense strand, and a blunt end at the 5'-end of the antisense strand.

In another particular embodiment, a RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker;
    (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
    (iv) phosphorothioate internucleotide linkages between nucleotide positions 1 and 2, and between nucleotide positions 2 and 3 (counting from the 5' end);
  and
  (b) an antisense strand having:
    (i) a length of 23 nucleotides;
    (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
    (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
  wherein the RNAi agents have a two nucleotide overhang at the 3'-end of the antisense strand, and a blunt end at the 5'-end of the antisense strand.

In another particular embodiment, a RNAi agent of the present invention comprises:
  (a) a sense strand having:
    (i) a length of 21 nucleotides;
    (ii) an ASGPR ligand attached to the 3'-end, wherein said ASGPR ligand comprises three GalNAc derivatives attached through a trivalent branched linker;
    (iii) 2'-OMe modifications at positions 1 to 6, 8, 10, 12, 14, and 16 to 21, and 2'-F modifications at positions 7, 9, 11, 13, and 15; and
    (iv) phosphorothioate internucleotide linkages between nucleotide positions 1 and 2, and between nucleotide positions 2 and 3 (counting from the 5' end); and
  (b) an antisense strand having:
    (i) a length of 23 nucleotides;
    (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
    (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 9, and 12 to 21, and 2'-F modifications at positions 10, and 11; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, and 13, and 2'-OMe modifications at positions 2, 4, 6, 8, 12, and 14 to 21; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
  (iv) phosphorothioate internucleotide linkages between nucleotide positions 1 and 2, and between nucleotide positions 2 and 3 (counting from the 5' end); and
(b) an antisense strand having:
  (i) a length of 25 nucleotides;
  (ii) 2'-OMe modifications at positions 1, 4, 6, 7, 9, 11 to 13, 15, 17, and 19 to 23, 2'-F modifications at positions 2, 3, 5, 8, 10, 14, 16, and 18, and deoxynucleotides (e.g. dT) at positions 24 and 25 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end); and
(b) an antisense strand having:
  (i) a length of 23 nucleotides;
  (ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end);

and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end);
and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-7. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA,* 1989, 86: 6553-6556). In other embodiments, the ligand is cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting, or lifetime of an iRNA agent into which it is incorporated. In some embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. In one embodiment, such a lipid or lipid-based molecule binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In one embodiment, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all. In one embodiment, the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In one embodiment, the agent is amphipathic. An exemplary agent is a peptide such as that or antennopedia. If the agent is a peptide, it can be modified, including a peptidylmimetic, invertomers, non-peptide or pseudo-peptide linkages, and use of D-amino acids. In one embodiment, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 14). An RFGF analogue (e.g., amino acid sequence AALLPVLLAAP (SEQ ID NO:15) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:16) and the Drosophila Antennapedia protein (RQIKIWFQNRRMKWKK (SEQ ID NO:17) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand, e.g., PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

Formula II

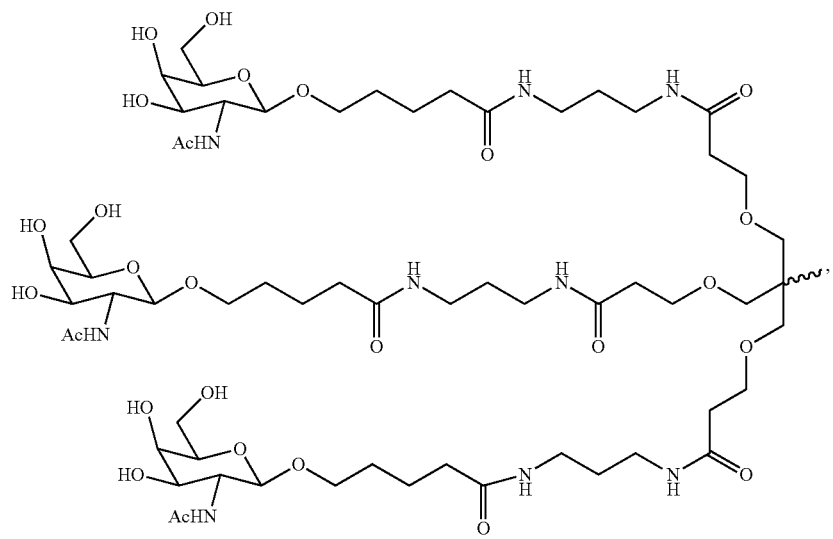

Formula III

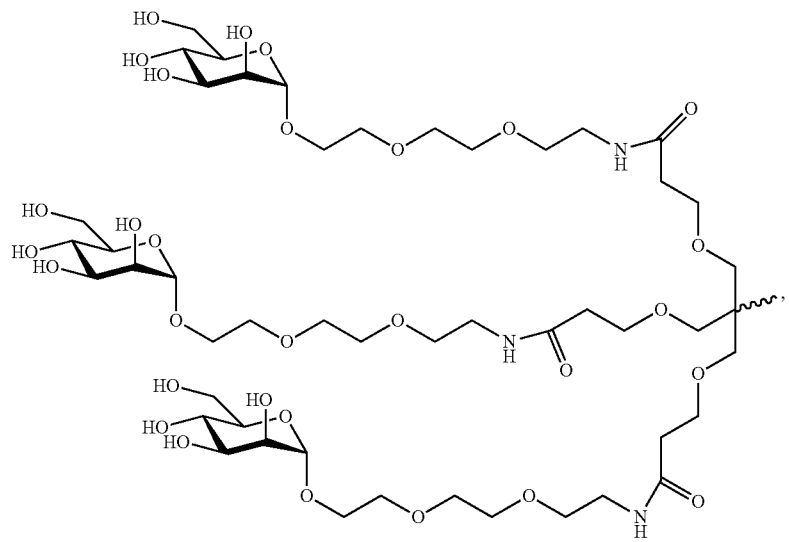

-continued
Formula IV
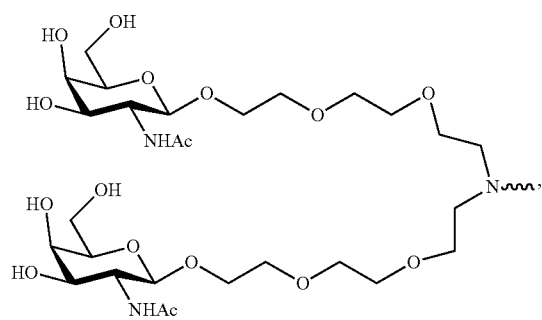
Formula V
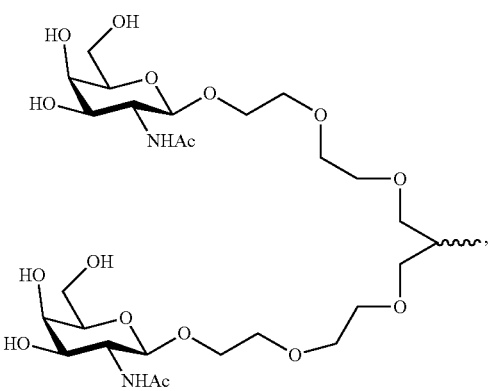
Formula VI
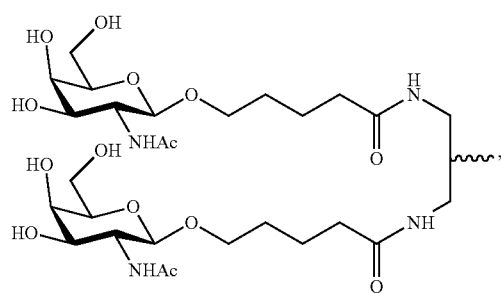
Formula VII
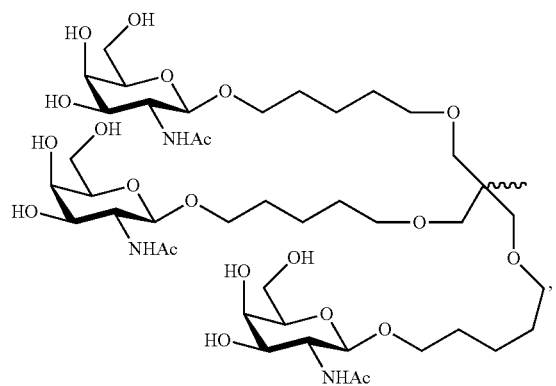
Formula VIII
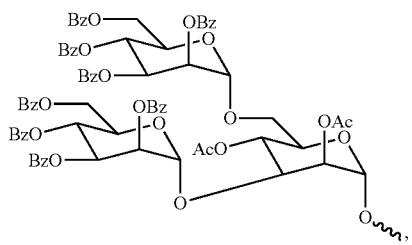
Formula IX
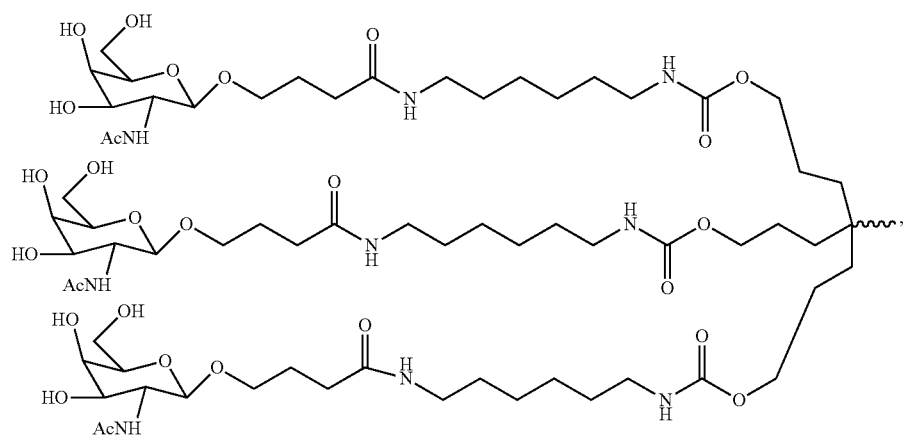

Formula X
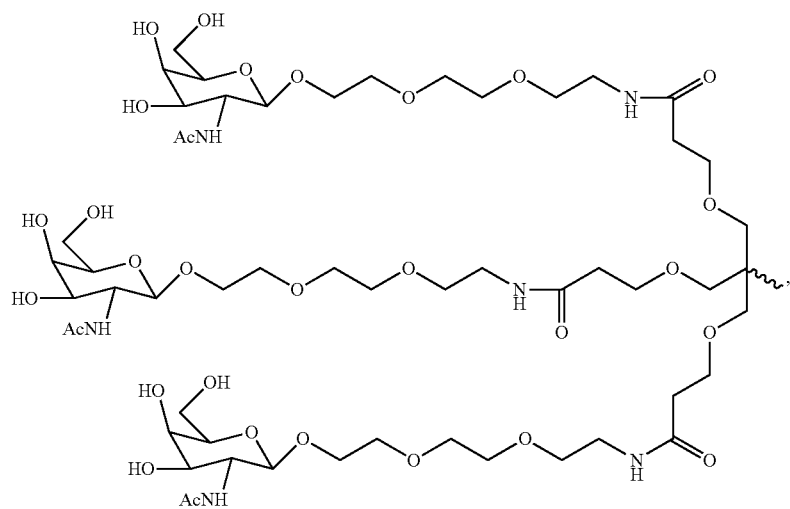
Formula XI
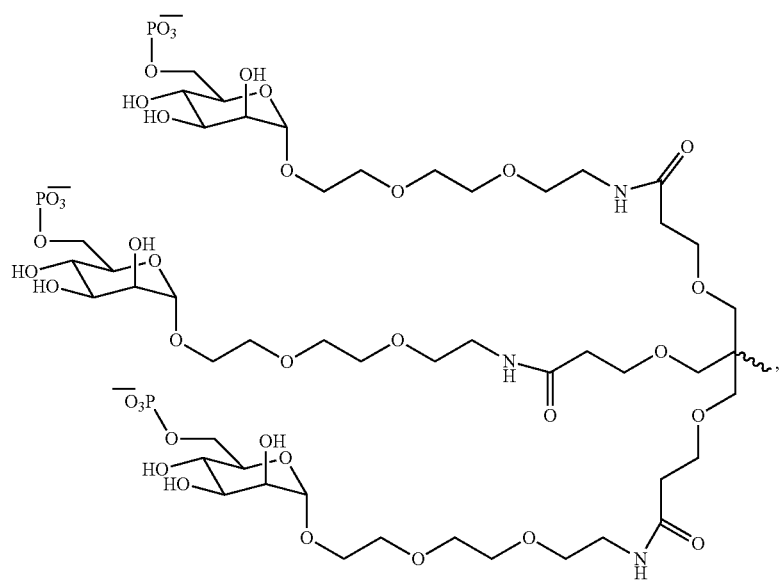

-continued
Formula XII
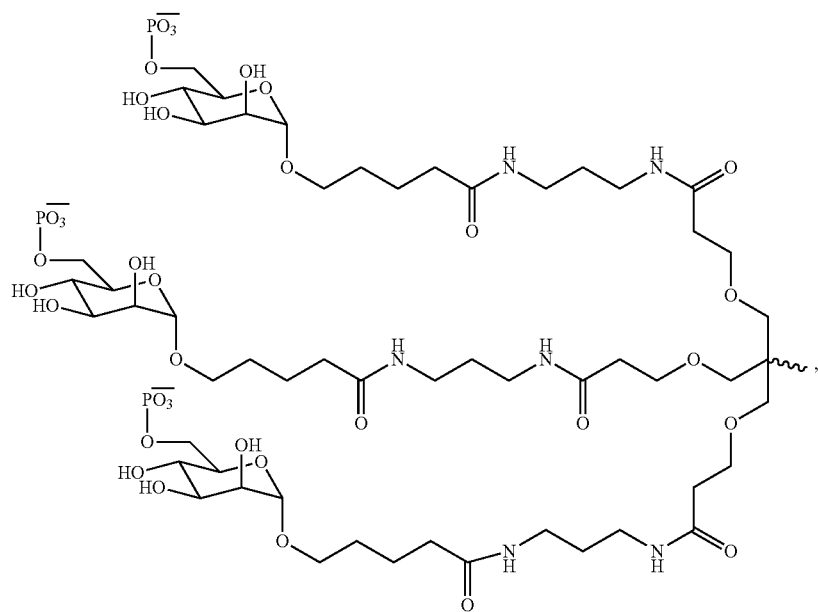
Formula XIII
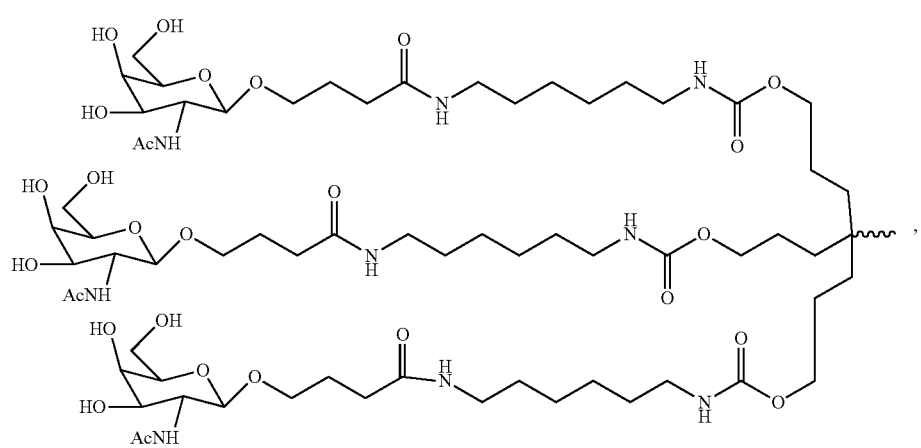
Formula XIV
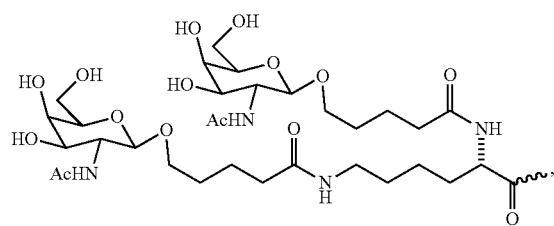
Formula XV
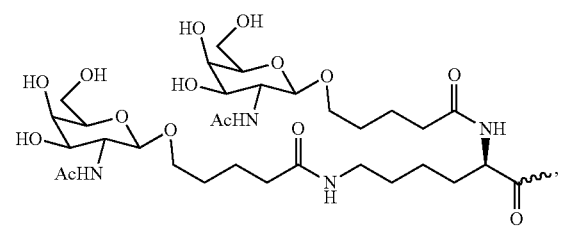
Formula XVI
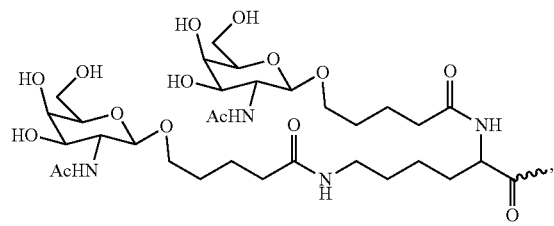
Formula XVII
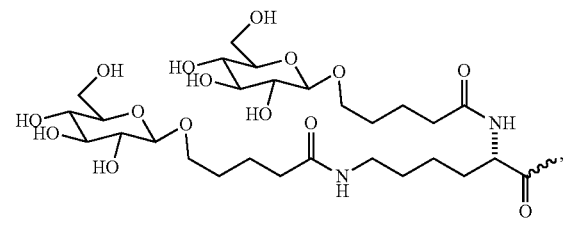

-continued
Formula XVIII
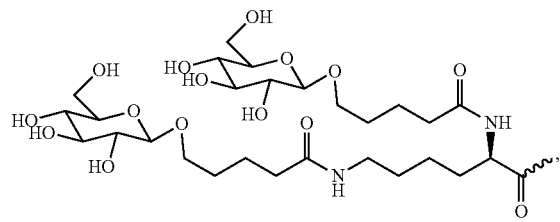
Formula XIX
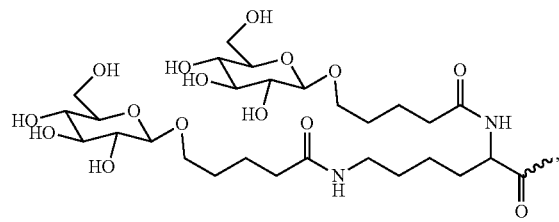
Formula XX
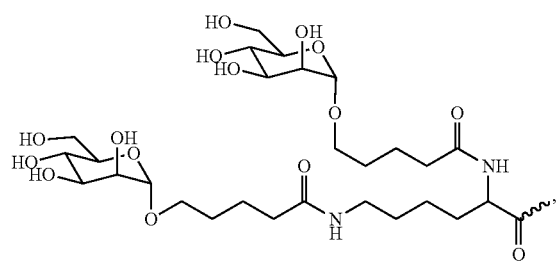
Formula XXI
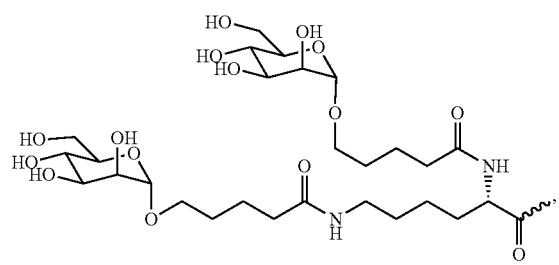
Formula XXII
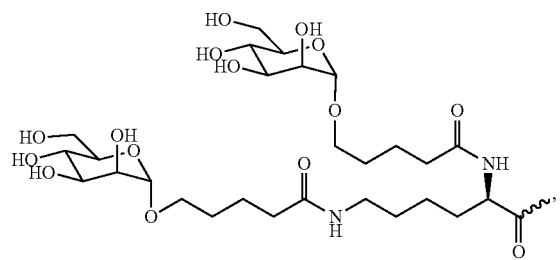
Formula XXIII
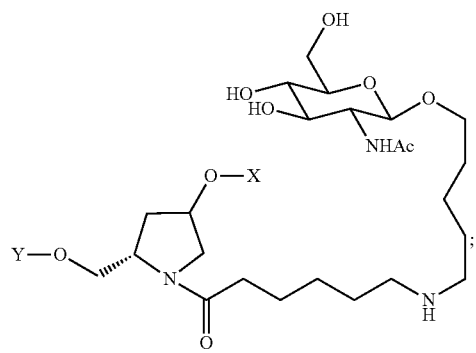
(Formula XXIV)
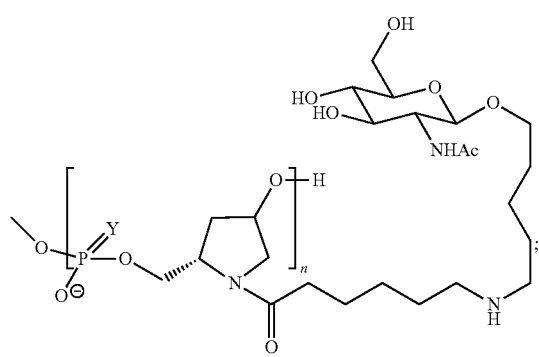
wherein Y is O or S and n is 3-6

(Formula XXV)
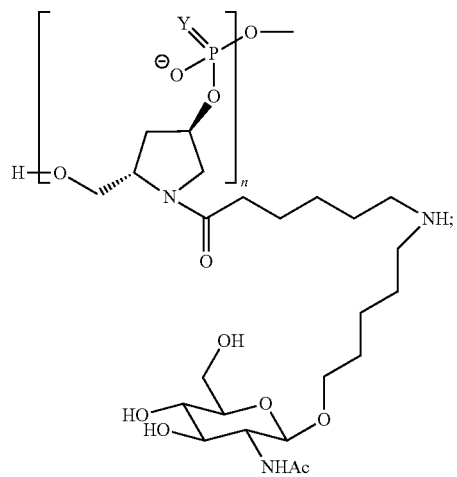
wherein Y is O or S and n is 3-6
Formula XXVI
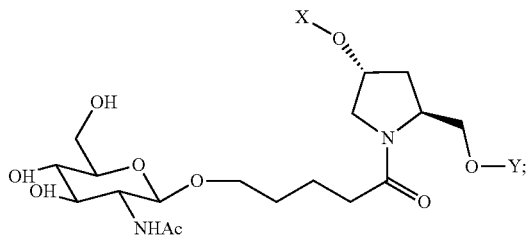
(Formula XXVII)
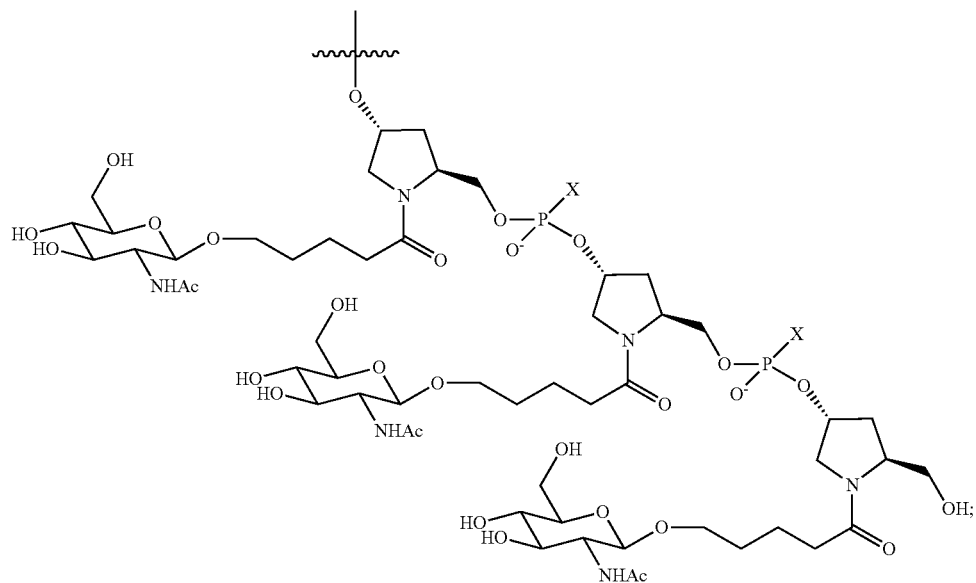
wherein X is O or S Formula XXVII
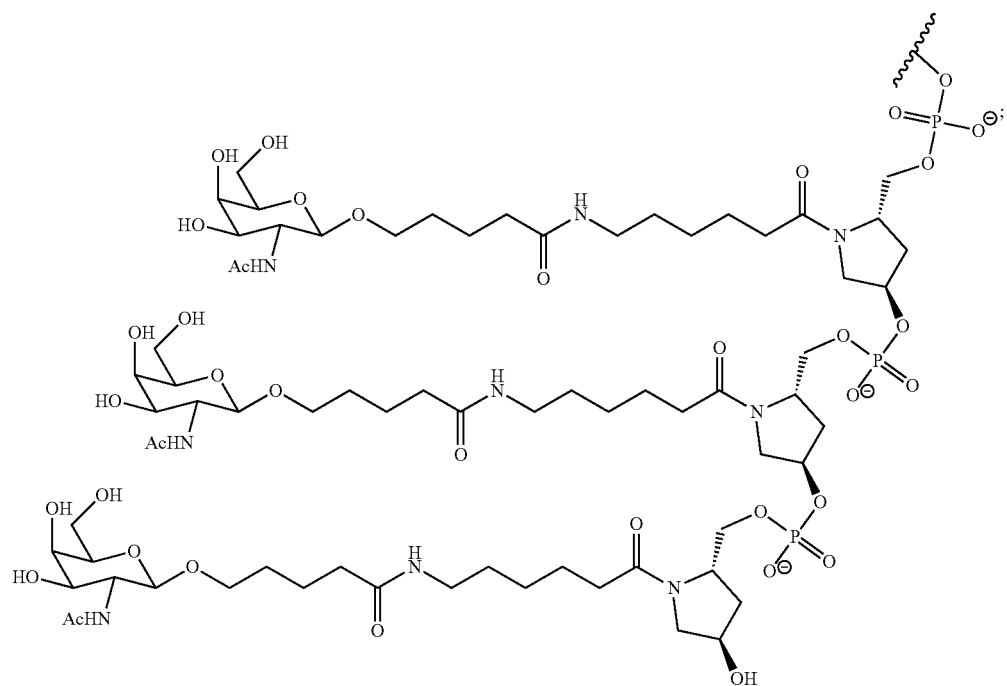
Formula XXIX
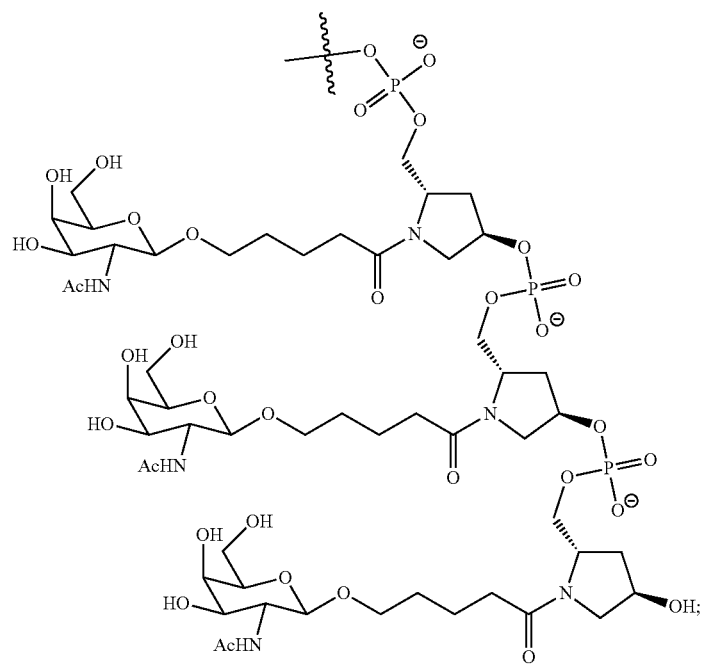

Formula XXX
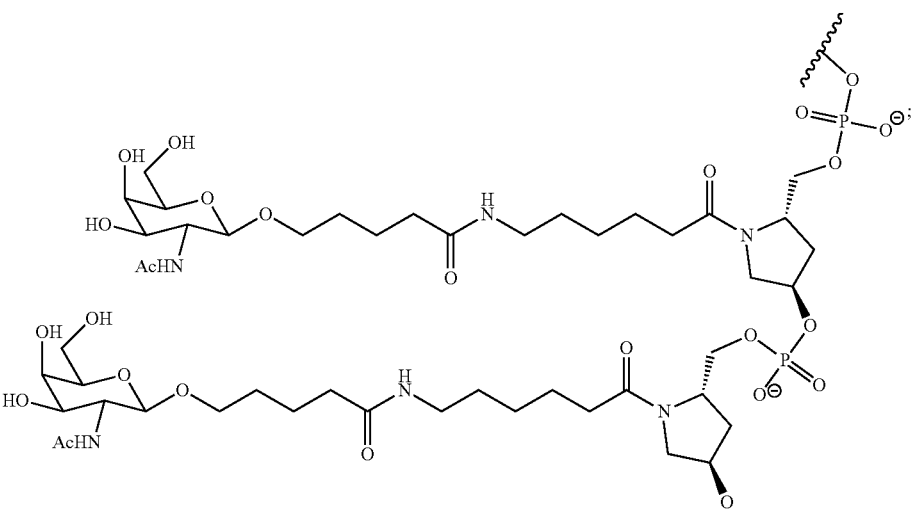
Formula XXXI
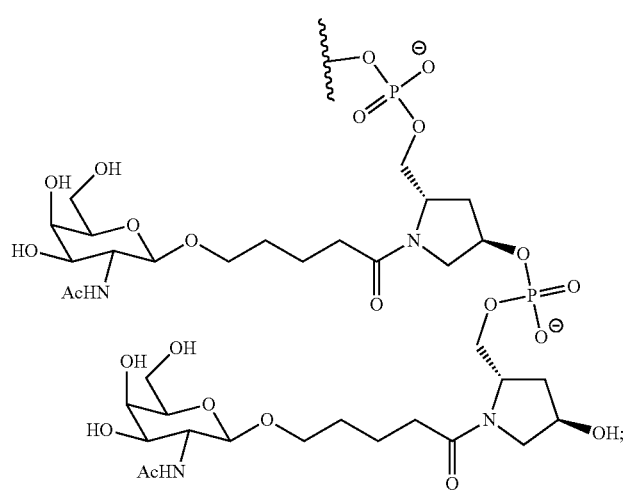
Formula XXXII
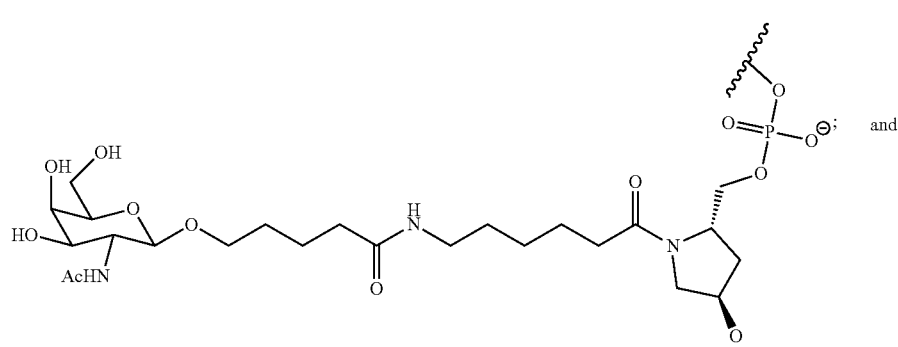
Formula XXXIII
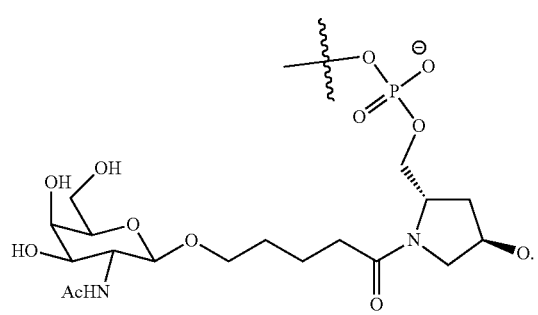

-continued

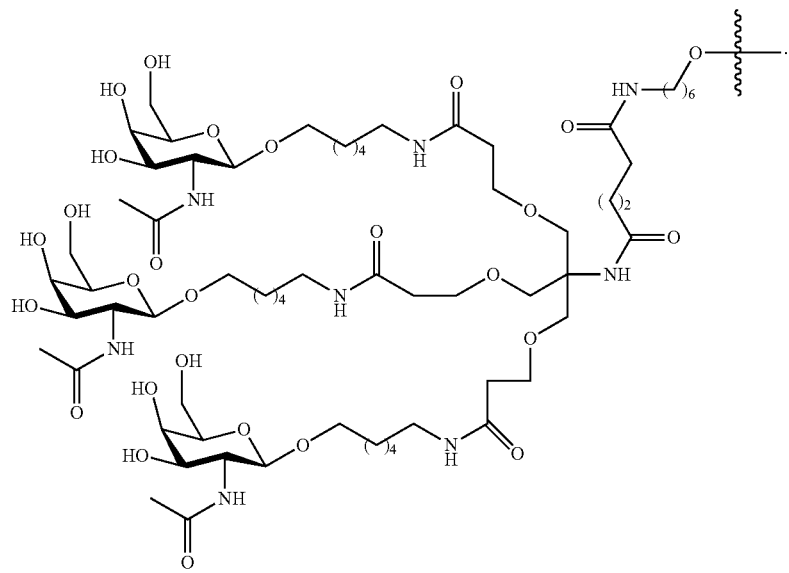

Formula XXXIV

In another embodiment, a carbohydrate conjugate for use in the compositions and methods of the invention is a monosaccharide. In one embodiment, the monosaccharide is an N-acetylgalactosamine, such as

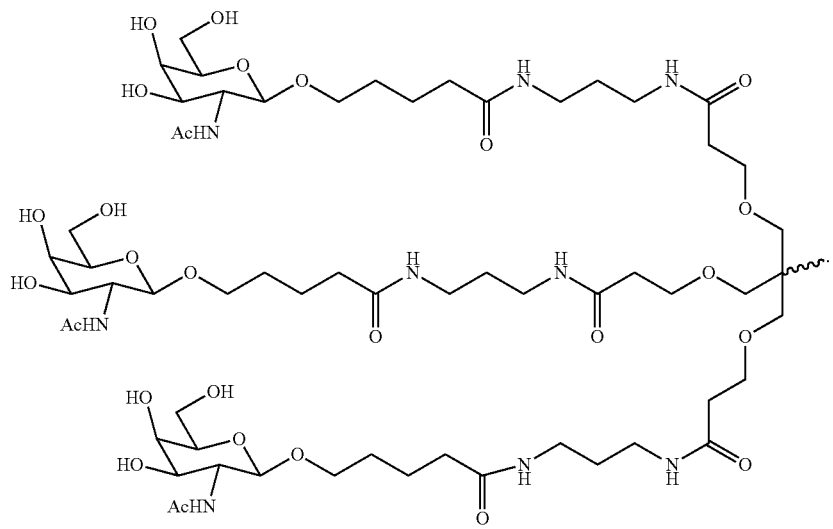

Formula II

In some embodiments, the RNAi agent is attached to the carbohydrate conjugate via a linker as shown in the following schematic, wherein X is O or S

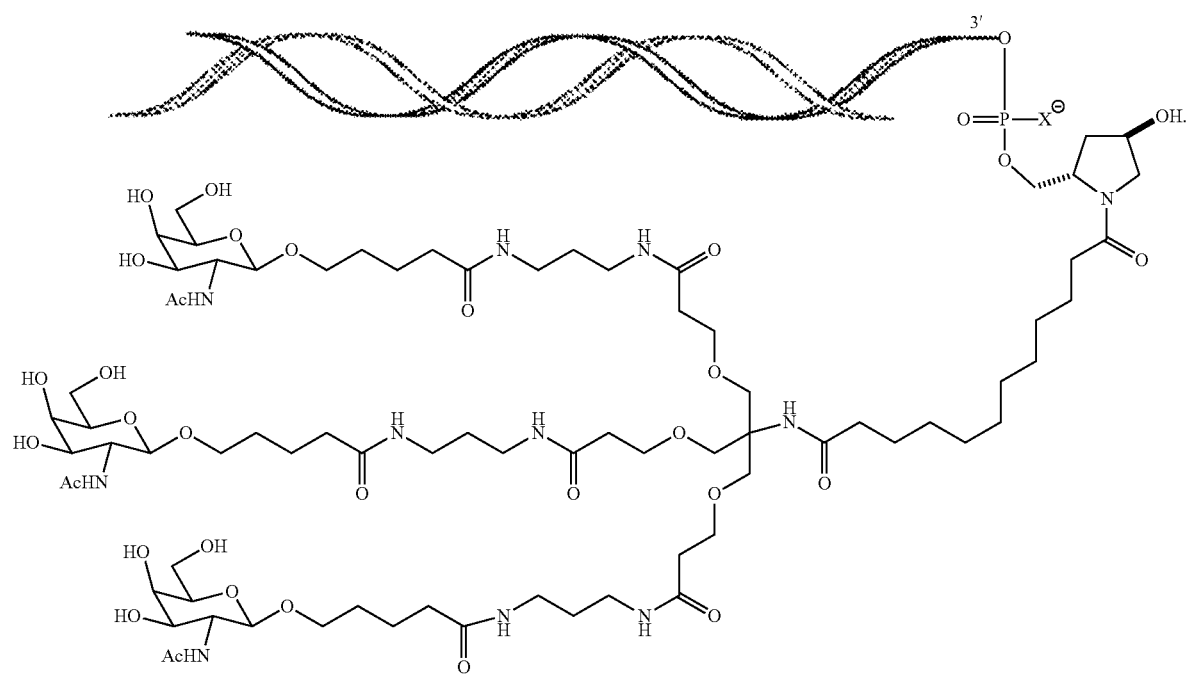
In some embodiments, the RNAi agent is conjugated to L96 as defined in Table 1 and shown below:
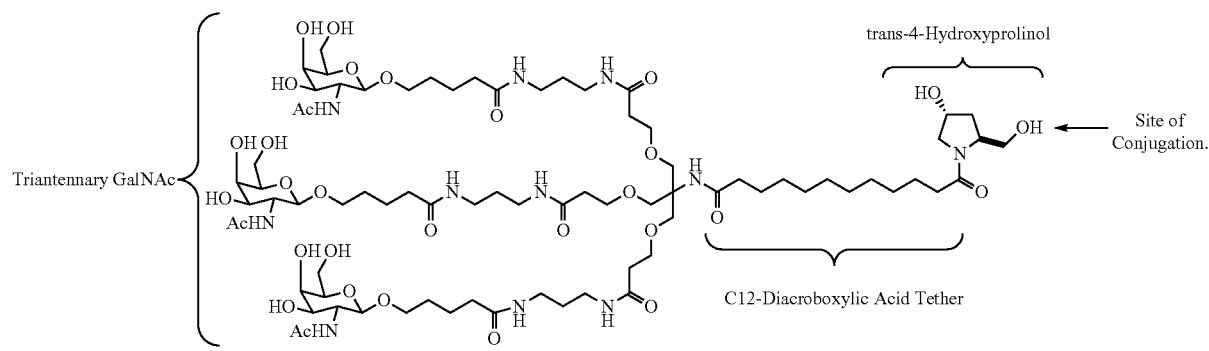
Another representative carbohydrate conjugate for use in the embodiments described herein includes, but is not limited to,

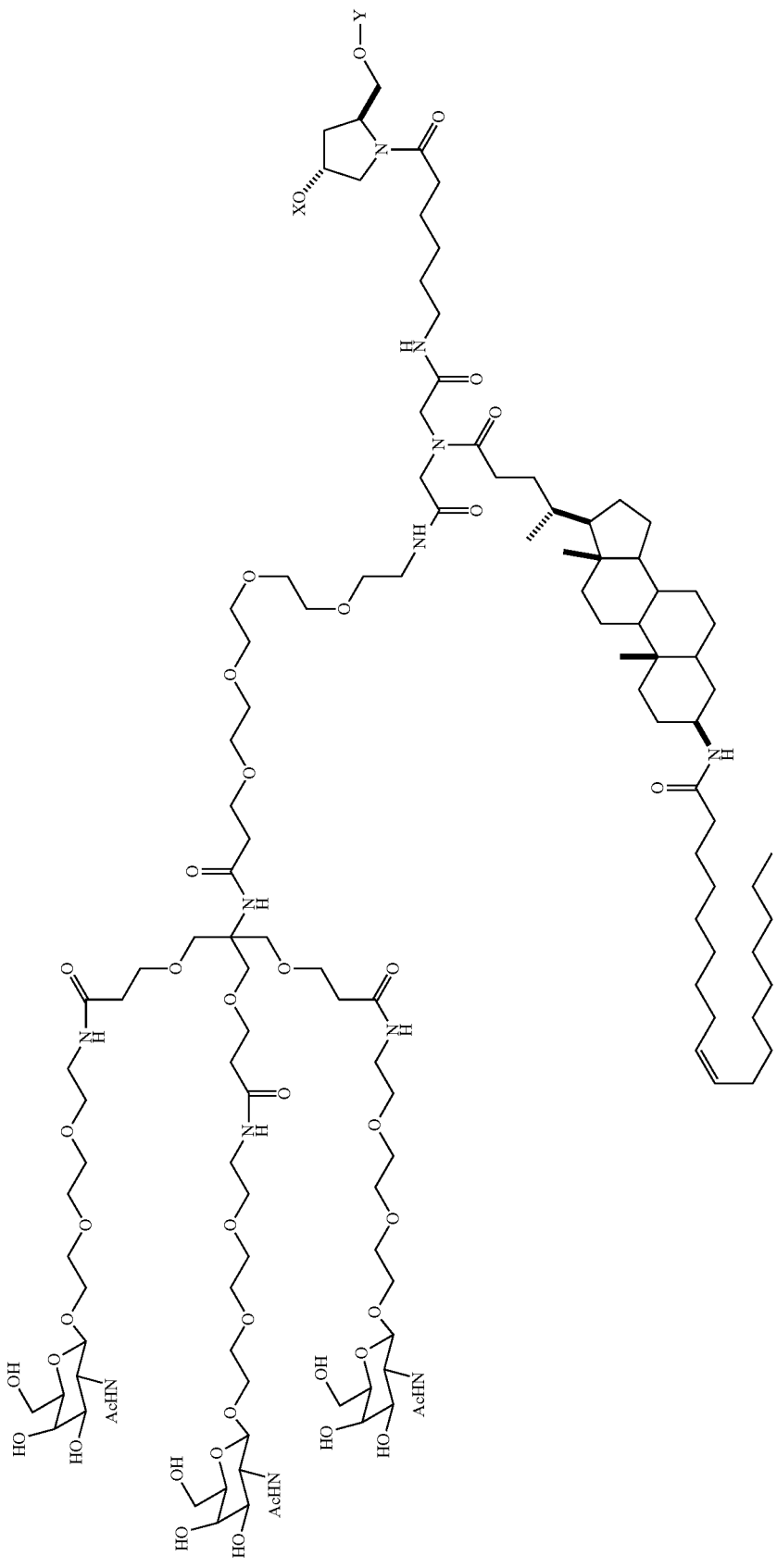

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

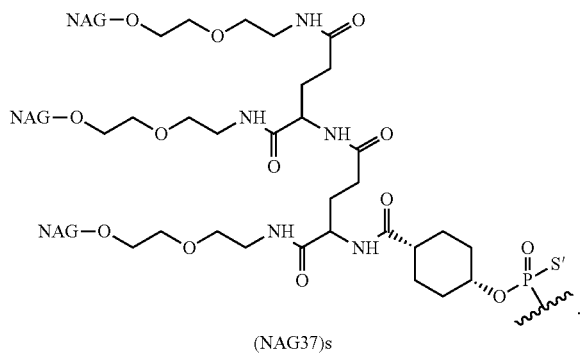

(NAG37)s

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antsisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NRB, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In an exemplary embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments a phosphate-based linking group is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

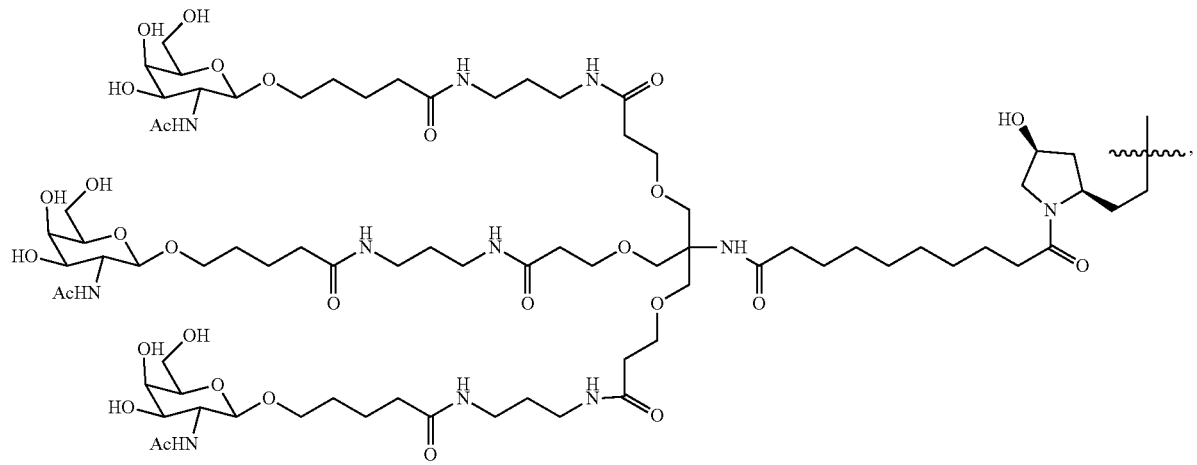

(Formula XXXVIII)

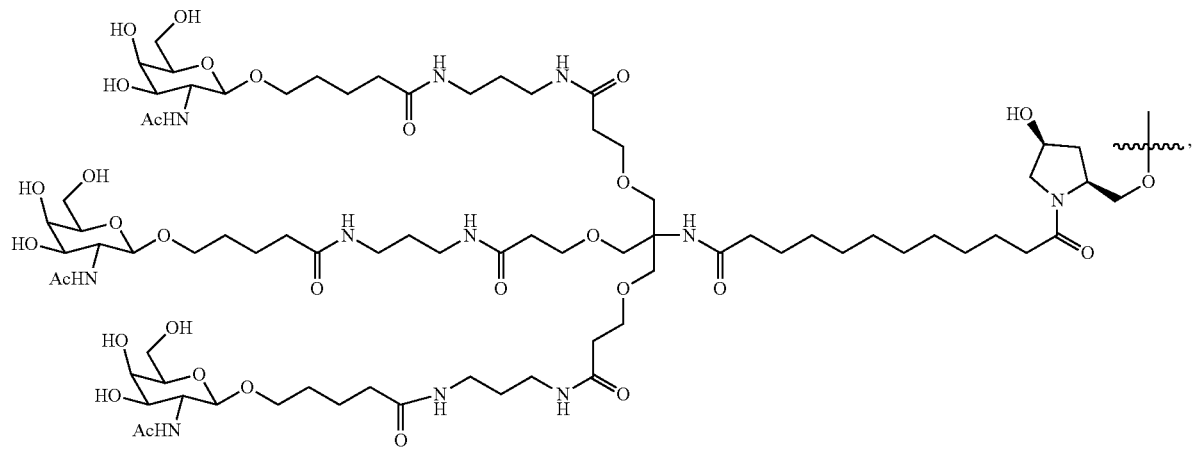

(Formula XXXIX)

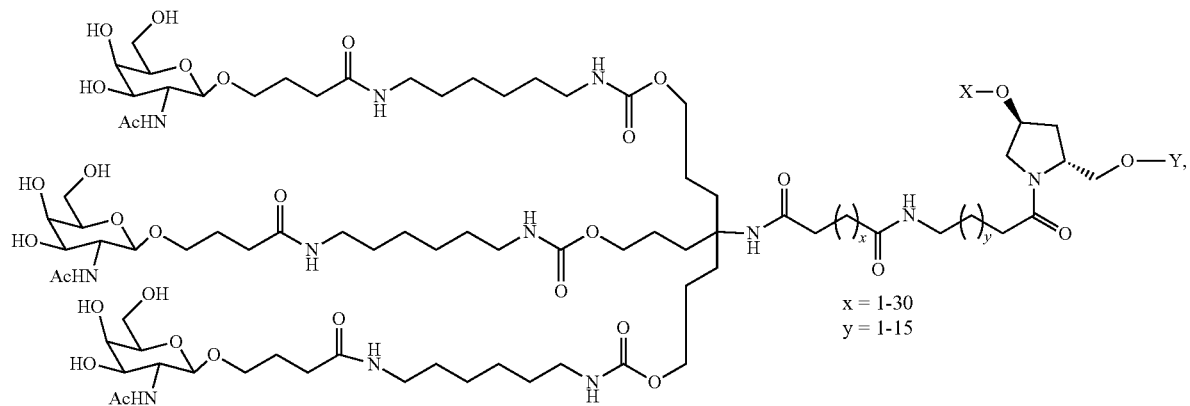

x = 1-30
y = 1-15

(Formula XL)
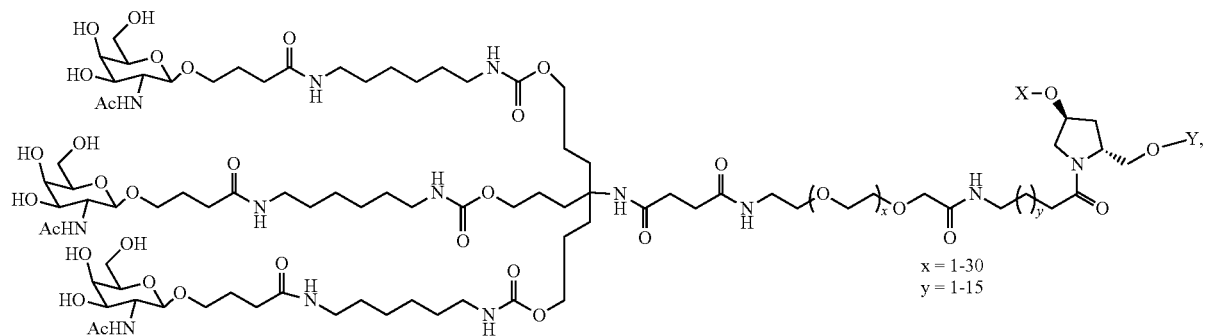
x = 1-30
y = 1-15
(Formula XLI)
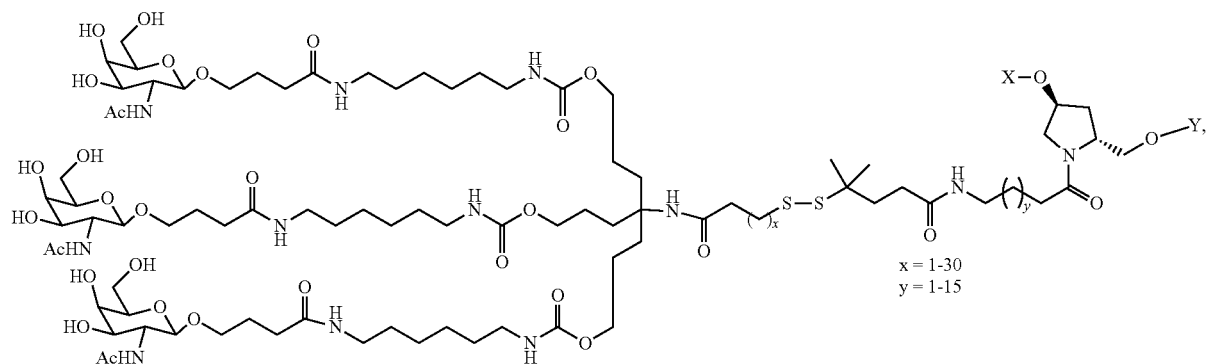
x = 1-30
y = 1-15
(Formula XLII)
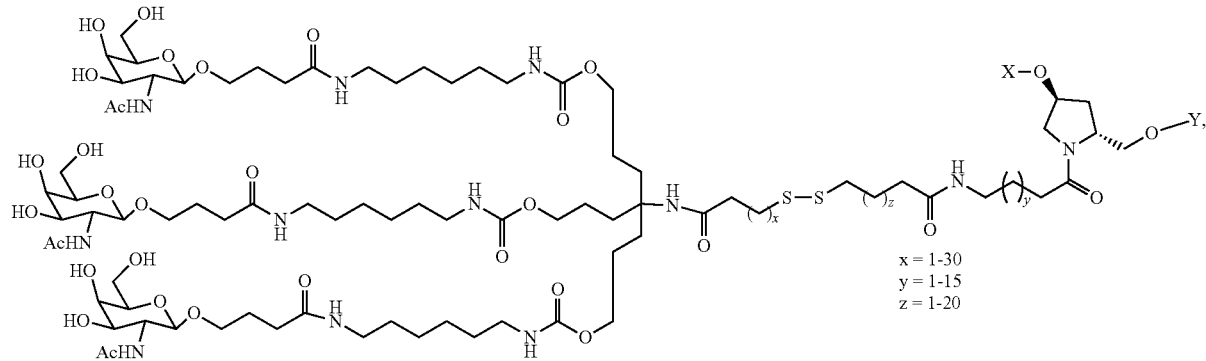
x = 1-30
y = 1-15
z = 1-20
(Formula XLIII)
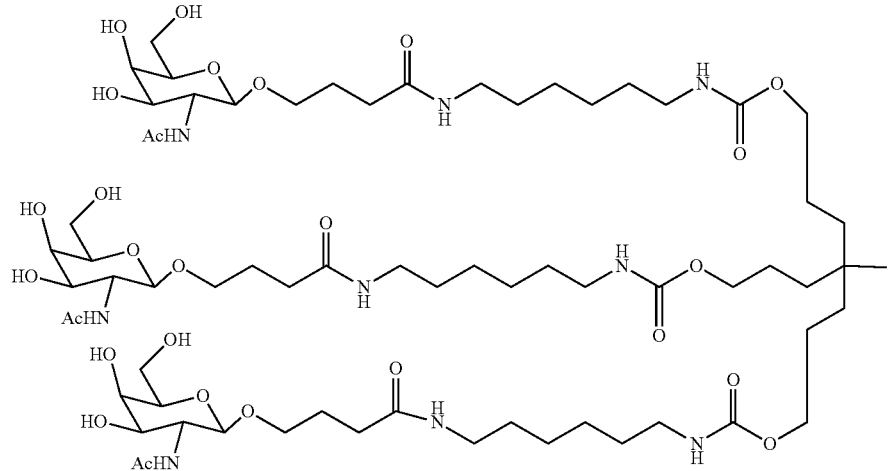

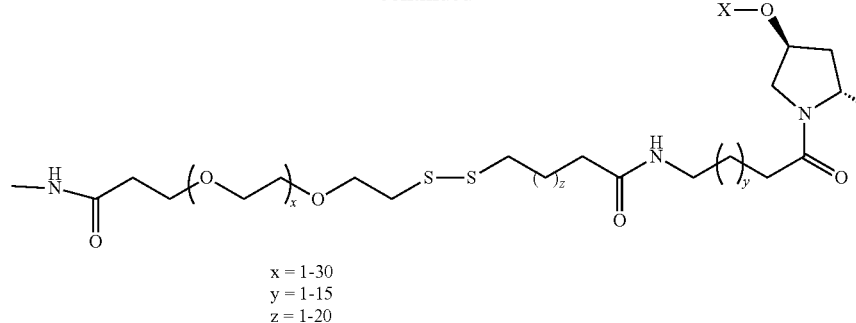

x = 1-30
y = 1-15
z = 1-20

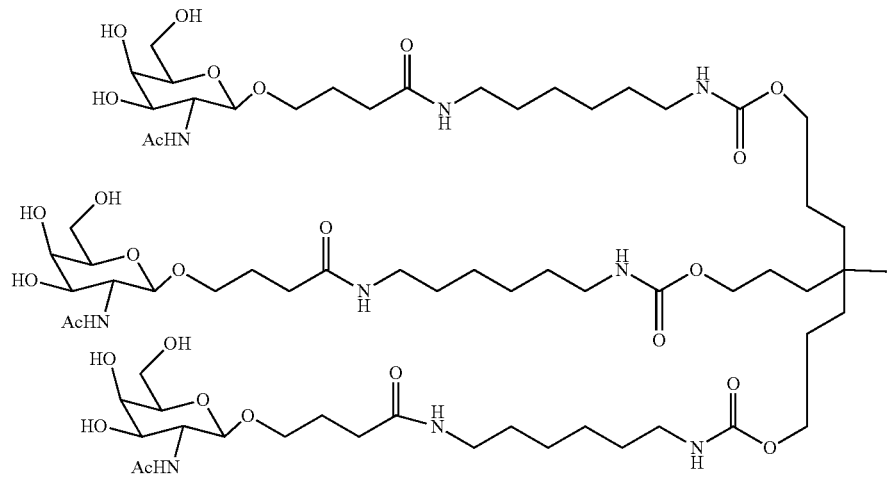

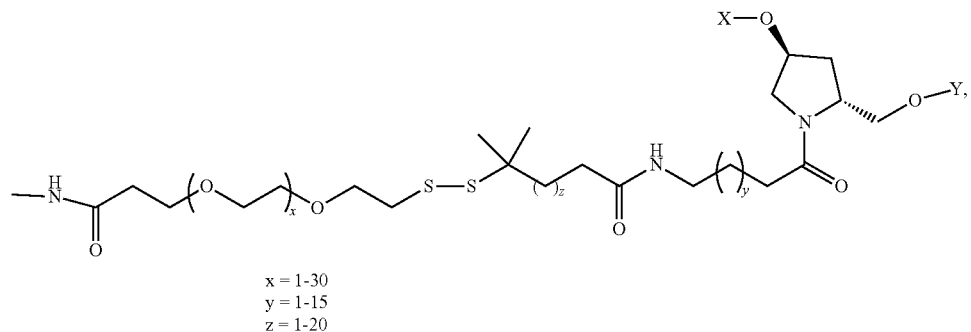

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

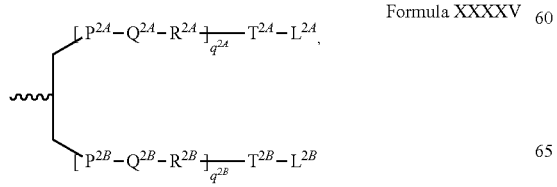

Formula XXXXV

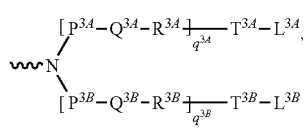

Formula XLVI

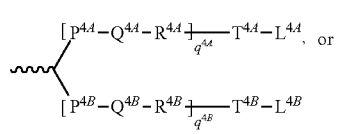

Formula XLVII

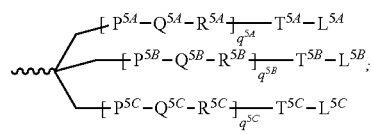

Formula XLVIII wherein:
q2A, q2B, q3A, q3B, q4A, q4B, q5A, q5B and q5C represent independently for each occurrence 0-20 and wherein the repeating unit can be the same or different; $P^{2A}, P^{2B}, P^{3A}, P^{3B}, P^{4A}, P^{4B}, P^{5A}, P^{5B}, P^{5C}, T^{2A}, T^{2B}, T^{3A}, T^{3B}, T^{4A}, T^{4B}, T^{4A}, T^{5B}, T^{5C}$ are each independently for each occurrence absent, CO, NH, O, S, OC(O), NHC(O), $CH_2$, $CH_2NH$ or $CH_2O$;
$Q^{2A}, Q^{2B}, Q^{3A}, Q^{3B}, Q^{4A}, Q^{4B}, Q^{5A}, Q^{5B}, Q^{5C}$ are independently for each occurrence absent, alkylene, substituted alkylene wherein one or more methylenes can be interrupted or terminated by one or more of O, S, S(O), $SO_2$, $N(R^N)$, $C(R')=C(R'')$, C≡C or C(O);
$R^{2A}, R^{2B}, R^{3A}, R^{3B}, R^{4A}, R^{4B}, R^{5A}, R^{5B}, R^{5C}$ are each independently for each occurrence absent, NH, O, S, $CH_2$, C(O)O, C(O)NH, $NHCH(R^a)C(O)$, —C(O)—CH$(R^a)$—NH—, CO, CH=N—O,

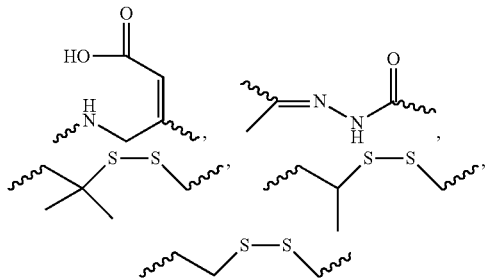

or heterocyclyl;
$L^{2A}, L^{2B}, L^{3A}, L^{3B}, L^{4A}, L^{4B}, L^{5A}, L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

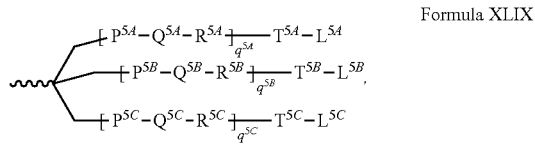

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a TMPRSS6-associated disorder, e.g., a disorder associated with iron overload and/or a disorder of ineffective erythropoiesis) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting the TMPRSS6 gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a TMPRSS6-associated disorder, e.g., a disorder associated with iron overload and/or a disorder of ineffective erythropoiesis. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a TMPRSS6 gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a TMPRSS6 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, such as, about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations
i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a TMPRSS63-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as, an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of a TMPRSS6-associated disorder, e.g., a disorder associated with iron overload and/or a disorder of ineffective erythropoiesis. In any event, the administering physician can adjust the amount and timing of iRNA administration on the basis of results observed using standard measures of efficacy known in the art or described herein.

VI. Methods for Inhibiting TMPRSS6 Expression

The present invention also provides methods of inhibiting expression of a TMPRSS6 gene in a cell. The methods include contacting a cell with an RNAi agent, e.g., double stranded RNA agent, in an amount effective to inhibit expression of TMPRSS6 in the cell, thereby inhibiting expression of TMPRSS6 in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a TMPRSS6" is intended to refer to inhibition of expression of any TMPRSS6 gene (such as, e.g., a mouse TMPRSS6 3 gene, a rat TMPRSS6 gene, a monkey TMPRSS6 gene, or a human TMPRSS6 gene) as well as variants or mutants of a TMPRSS6 gene. Thus, the TMPRSS6 gene may be a wild-type TMPRSS6 gene, a mutant TMPRSS6 gene, or a transgenic TMPRSS6 gene in the context of a genetically manipulated cell, group of cells, or organism.

"Inhibiting expression of a TMPRSS6 gene" includes any level of inhibition of a TMPRSS6 gene, e.g., at least partial suppression of the expression of a TMPRSS6 gene. The expression of the TMPRSS6 gene may be assessed based on the level, or the change in the level, of any variable associated with TMPRSS6 gene expression, e.g., TMPRSS6 mRNA level or TMPRSS6 protein level. The expression of a TMPRSS6 may also be assessed indirectly based on the hepcidin mRNA level, hepcidin protein level, or iron levels in tissues or serum. This level may be assessed in an individual cell or in a group of cells, including, for example, a sample derived from a subject. It is understood that TMPRSS6 is expressed predominantly in the liver.

Inhibition may be assessed by a decrease in an absolute or relative level of one or more variables that are associated with TMPRSS6 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a TMPRSS6 gene is inhibited by at least 50%, 55%, 60%, 65%, 70%, 75%, 80%, 85%, 90%, or 95%, or to below the level of detection of the assay. In some embodiments, expression of a TMPRSS6 gene is inhibited by at least 70%. It is further understood that inhibition of TMPRSS6 expression in certain tissues, e.g., in liver, without a significant inhibition of expression in other tissues, e.g., brain, may be desirable. In some embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., TMPRSS6), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a TMPRSS6 gene may be manifested by a reduction of the amount of mRNA expressed by a first cell or group of cells (such cells may be present, for example, in a sample derived from a subject) in which a TMPRSS6 gene is transcribed and which has or have been treated (e.g., by contacting the cell or cells with an iRNA of the invention, or by administering an iRNA of the invention to a subject in which the cells are or were present) such that the expression of a TMPRSS6 gene is inhibited, as compared to a second cell or group of cells substantially identical to the first cell or group of cells but which has not or have not been so treated (control cell(s) not treated with an iRNA or not treated with an iRNA targeted to the gene of interest). In some embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a TMPRSS6 gene may be assessed in terms of a reduction of a parameter that is functionally linked to TMPRSS6 gene expression, e.g., TMPRSS6 protein level in blood or serum from a subject. TMPRSS6 gene silencing may be determined in any cell expressing TMPRSS6, either endogenous or heterologous from an expression construct, and by any assay known in the art.

Inhibition of the expression of a TMPRSS6 protein may be manifested by a reduction in the level of the TMPRSS6 protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of a TMPRSS6 gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of TMPRSS6 mRNA that is expressed by a cell or group of cells may be determined using any method known in the art for assessing mRNA expression. In one embodiment, the level of expression of TMPRSS6 in a sample is determined by detecting a transcribed polynucleotide, or portion thereof, e.g., mRNA of the TMPRSS6 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of TMPRSS6 is determined using a nucleic acid probe. The term "probe", as used herein, refers to any molecule that is capable of selectively binding to a specific TMPRSS6. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to TMPRSS6 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of TMPRSS6 mRNA.

An alternative method for determining the level of expression of TMPRSS6 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of TMPRSS6 is determined by quantitative fluorogenic RT-PCR (i.e., the TaqMan™ System). In some embodiments, expression level is determined by the method provided in Example 2 using, e.g., a 10 nM siRNA concentration, in the species matched cell line.

The expression levels of TMPRSS6 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of TMPRSS6 expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein. In some embodiments, expression level is determined by the method provided in Example 2 using a 10 nM siRNA concentration in the species matched cell line.

The level of TMPRSS6 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in TMPRSS6 mRNA or protein level (e.g., in a liver biopsy).

In some embodiments of the methods of the invention, the iRNA is administered to a subject such that the iRNA is delivered to a specific site within the subject. The inhibition of expression of TMPRSS6 may be assessed using measurements of the level or change in the level of TMPRSS6 mRNA or TMPRSS6 protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of TMPRSS6, thereby preventing or treating a TMPRSS6-associated disorder, e.g., a disorder associated with iron overload and/or a disorder of ineffective erythropoiesis. In the methods of the invention the cell may be contacted with the siRNA in vitro or in vivo, i.e., the cell may be within a subject.

A cell suitable for treatment using the methods of the invention may be any cell that expresses a TMPRSS6 gene, e.g., a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, TMPRSS6 expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the TMPRSS6 gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In one aspect, the present invention also provides methods for inhibiting the expression of a TMPRSS6 gene in a mammal. The methods include administering to the mammal a composition comprising a dsRNA that targets a TMPRSS6 gene in a cell of the mammal and maintaining the mammal for a time sufficient to obtain degradation of the mRNA transcript of the TMPRSS6 gene, thereby inhibiting expression of the TMPRSS6 gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the TMPRSS6 gene or protein expression. In other embodiments, a blood sample serves as the subject sample for monitoring the reduction in the TMPRSS6 protein expression.

The present invention further provides methods of treatment in a subject in need thereof, e.g., a subject diagnosed with a TMPRSS6-associated disorder, such as a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia. In one embodiment, a subject having a TMPRSS6-associated disorder has hereditary hemochromatosis. In another embodiment, a subject having a TMPRSS6-associated disorder has β-thalassemia. In another embodiment, a subject having a TMPRSS6-associated disorder has polycythemia vera.

The present invention further provides methods of prophylaxis in a subject in need thereof. The treatment methods of the invention include administering an iRNA of the invention to a subject, e.g., a subject that would benefit from a reduction of TMPRSS6 expression, in a prophylactically effective amount of a dsRNA targeting a TMPRSS6 gene or a pharmaceutical composition comprising a dsRNA targeting a TMPRSS6 gene.

In one aspect, the present invention provides methods of treating a subject having a disorder that would benefit from reduction in TMPRSS6 expression, e.g., a TMPRSS6-associated disease, such as a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia. Treatment of a subject that would benefit from a reduction and/or inhibition of TMPRSS6 gene expression includes therapeutic treatment (e.g., a subject is having elevated iron levels) and prophylactic treatment (e.g., the subject is not having elevated iron levels or a subject may be at risk of developing elevated iron levels).

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of TMPRSS6 gene expression are subjects susceptible to or diagnosed with a TMPRSS6-associated disorder, such as a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia. In an embodiment, the method includes administering a composition featured herein such that expression of the target a TMPRSS6 gene is decreased, such as for about 1, 2, 3, 4, 5, 6, 1-6, 1-3, or 3-6 months per dose. In certain embodiments, the composition is administered once every 3-6 months.

In one embodiment, the iRNAs useful for the methods and compositions featured herein specifically target RNAs (primary or processed) of the target TMPRSS6 gene. Compositions and methods for inhibiting the expression of these genes using iRNAs can be prepared and performed as described herein.

Administration of the iRNA according to the methods of the invention may result prevention or treatment of a TMPRSS6-associated disorder, e.g., a disorder associated with iron overload and/or a disorder of ineffective erythropoiesis, e.g., hereditary hemochromatosis, β-thalassemia (e.g., β-thalassemia major and β-thalassemia intermedia), polycythemia vera, myelodysplastic syndrome, congenital dyserythropoietic anemias, pyruvate kinase deficiency, erythropoietic porphyria, Parkinson's Disease, Alzheimer's Disease or Friedreich's Ataxia. Subjects can be administered a therapeutic amount of iRNA, such as about 0.01 mg/kg to about 200 mg/kg.

In one embodiment, the iRNA is administered subcutaneously, i.e., by subcutaneous injection. In another embodiment, the iRNA is administered intravenously, i.e., by intravenous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of TMPRSS6 gene expression, e.g., a subject having a TMPRSS6-associated disease, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include either a single iRNA agent of the invention, further include administering to the subject one or more additional therapeutic agents.

For example, in certain embodiments, an iRNA targeting TMPRSS6 is administered in combination with, e.g., an agent useful in treating a disorder associated with iron overload. For example, additional agents suitable for treating a subject that would benefit from reducton in TMPRSS6 expression, e.g., a subject having a disorder associated with iron overload, may include iron chelators (e.g., desferoxamine), folic acid, a blood transfusion, a phlebotomy, agents to manage ulcers, agents to increase fetal hemoglobin levels (e.g., hydroxyurea), agents to control infection (e.g., antibiotics and antivirals), agents to treat thrombotic state, or a stem cell or bone marrow transplant. A stem cell transplant can utilize stem cells from an umbilical cord, such as from a relative, e.g., a sibling. Exemplary iron chelators include desferoxamine, Deferasirox (Exjade), deferiprone, vitamin E, wheat germ oil, tocophersolan, and indicaxanthin.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

VIII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of TMPRSS6 (e.g., means for measuring the inhibition of TMPRSS6 mRNA, TMPRSS6 protein, and/or TMPRSS6 activity). Such means for measuring the inhibition of TMPRSS6 may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1 iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human Transmembrane protease, serine 6 (TMPRSS6) gene (human NCBI refseqID NM_153609.4, NCBI GeneID: 164656) were designed using custom R and Python scripts. The human NM_153609.4 REFSEQ mRNA, has a length of 3197 bases.

Detailed lists of the unmodified TMPRSS6 sense and antisense strand nucleotide sequences are shown in Tables 2, 4 and 6. Detailed lists of the modified TMPRSS6 sense and antisense strand nucleotide sequences are shown in Tables 3, 5 and 7.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were designed, synthesized, and prepared using methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA·3HF (triethylamine trihydrofluoride). To each oligonucleotide solution in aqueous methylamine was added 200 μL of dimethyl sulfoxide (DMSO) and 300 μL TEA·3HF and the solution was incubated for approximately 30 mins at 60° C. After incubation, the plate was allowed to come to room temperature and crude oligonucleotides were precipitated by the addition of 1 mL of 9:1 acetonitrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1× PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2

In Vitro Screening Methods

Cell Culture and 384-Well Transfections

For transfections, Hep3b cells (ATCC, Manassas, VA) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 μl of Opti-MEM plus 0.1 μl of Lipofectamine RNAiMax per well (Invitrogen, Carlsbad CA cat #13778-150) to 2.5 μl of each siRNA duplex to an individual well in a 384-well plate. The mixture was then incubated at room temperature for 15 minutes. Forty μl of complete growth media without antibiotic containing ~1.5×10$^4$ cells were then added to the siRNA mixture. Cells were incubated for 24 hours prior to RNA purification. Single dose experiments were performed at 10 nM, 1 nM, and 0.1 nM final duplex concentration.

Total RNA Isolation Using DYNABEADS mRNA Isolation Kit (Invitrogen™, Part #: 610-12)

Cells were lysed in 75 μl of Lysis/Binding Buffer containing 3 μL of beads per well and mixed for 10 minutes on an electrostatic shaker. The washing steps were automated on a Biotek EL406, using a magnetic plate support. Beads were washed (in 90 μL) once in Buffer A, once in Buffer B, and twice in Buffer E, with aspiration steps in between. Following a final aspiration, complete 10 μL RT mixture was added to each well, as described below.

cDNA Synthesis Using ABI High Capacity cDNA Reverse Transcription Kit (Applied Biosystems, Foster City, CA, Cat #4368813)

A master mix of 1 μl 10× Buffer, 0.4 μl 25×dNTPs, 1 μl Random primers, 0.5 μl Reverse Transcriptase, 0.5 μl RNase inhibitor and 6.6 μl of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

Real time PCR

Two microlitre (μl) of cDNA were added to a master mix containing 0.5 μl of human GAPDH TaqMan Probe (4326317E), 0.5 μl human TMPRSS6, 2 μl nuclease-free water and 5 μl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 18) and antisense UCGA-AGuACUcAGCGuAAGdTsdT (SEQ ID NO: 19).

The results of the single dose screen of the agents in Tables 2, 3, 6 and 7 in Hep3b cells are shown in Table 8.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-L-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |

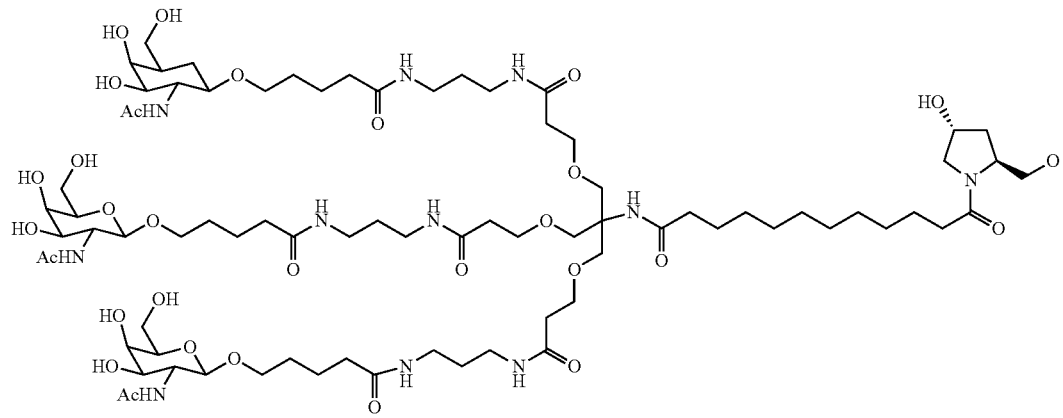 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2CO)CC(CO)C(O)C1O]

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| L10 | N-(cholesterylcarboxamidocaproyl)-4-hydroxyprolinol (Hyp-C6-Chol) |
| (Agn) | Adenosine-glycol nucleic acid (GNA) S-Isomer |
| (Cgn) | Cytidine-glycol nucleic acid (GNA) S-Isomer |
| (Ggn) | Guanosine-glycol nucleic acid (GNA) S-Isomer |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythimidine-3'-phosphate |
| dTs | 2'-deoxythimidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-urigine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| Q191s | N-[tris(GalNAc-alkyl)-amidododecanoyl]-(S)-pyrrolidin-3-ol-phosphorothioate (p-C12-(GalNAc-alkyl)3) |

TABLE 2

Unmodified Sense and Antisense Strand Sequences of TMPRSS6 dsRNA Agents

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1554875 | GCCUGUGAGGACUCCAAGAGU | 20 | 232-252 | ACUCUGGAGUCCUCACAGGCCU | 146 | 230-252 |
| AD-1554909 | GGUGCUACUCUGGUAUUUCCU | 21 | 324-344 | AGGAAATACCAGAGUAGCACCCC | 147 | 322-344 |
| AD-1554910 | GUGCUACUCUGGUAUUUCCUU | 22 | 325-345 | AAGGAAAUACCAGAGUAGCACCC | 148 | 323-345 |
| AD-1554911 | UGCUACUCUGGUAUUUCCUAU | 23 | 326-346 | ATAGGAAAUACCAGAGUAGCACC | 149 | 324-346 |
| AD-1554912 | GCUACUCUGGUAUUUCCUAGU | 24 | 327-347 | ACUAGGAAAUACCAGAGUAGCAC | 150 | 325-347 |
| AD-1554913 | CUACUCUGGUAUUUCCUAGGU | 25 | 328-348 | ACCUAGGAAAUACCAGAGUAGCA | 151 | 326-348 |
| AD-1554914 | UACUCUGGUAUUUCCUAGGGU | 26 | 329-349 | ACCCTAGGAAATACCAGAGUAGC | 152 | 327-349 |
| AD-1554915 | ACUCUGGUAUUUCCUAGGGUU | 27 | 330-350 | AACCCUAGGAAAUACCAGAGUAG | 153 | 328-350 |
| AD-1554916 | CUCUGGUAUUUCCUAGGGUAU | 28 | 331-351 | ATACCCTAGGAAAUACCAGAGUA | 154 | 329-351 |
| AD-1554917 | UCUGGUAUUUCCUAGGGUACU | 29 | 332-352 | AGUACCCUAGGAAAUACCAGAGU | 155 | 330-352 |
| AD-1554923 | AUUUCCUAGGGUACAAGGCGU | 30 | 338-358 | ACGCCUTGUACCCUAGGAAAUAC | 156 | 336-358 |
| AD-1554951 | GGUCAGCCAGGUGUACUCAGU | 31 | 366-386 | ACUGAGTACACCUGGCUGACCAU | 157 | 364-386 |
| AD-1554955 | AGCCAGGUGUACUCAGGCAGU | 32 | 370-390 | ACUGCCTGAGUACACCUGGCUGA | 158 | 368-390 |
| AD-1554992 | GCCACUUCUCCCAGGAUCUUU | 33 | 407-427 | AAAGAUCCUGGGAGAAGUGGCGA | 159 | 405-427 |
| AD-1554997 | UUCUCCCAGGAUCUUACCCGU | 34 | 412-432 | ACGGGUAAGAUCCUGGGAGAAGU | 160 | 410-432 |
| AD-1555000 | UCCCAGGAUCUUACCCGCCGU | 35 | 415-435 | ACGGCGGGUAAGAUCCUGGGAGA | 161 | 413-435 |
| AD-1555030 | GCCUUCCGCAGUGAAACCGCU | 36 | 445-465 | AGCGGUTCACTGCGGAAGGCAC | 162 | 443-465 |

TABLE 2-continued

Unmodified Sense and Antisense Strand Sequences of TMPRSS6 dsRNA Agents

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1555106 | CAACUCCAGCUCCGUCUAUUU | 37 | 522-542 | AAAUAGACGGAGCUGGAGUUGUA | 163 | 520-542 |
| AD-1555112 | CAGCUCCGUCUAUUCCUUUGU | 38 | 528-548 | ACAAAGGAAUAGACGGAGCUGGA | 164 | 526-548 |
| AD-1555114 | CUCACCUGCUUCUUCUGGUUU | 39 | 559-579 | AAACCAGAAGAAGCAGGUGAGGG | 165 | 557-579 |
| AD-1555115 | UCACCUGCUUCUUCUGGUUCU | 40 | 560-580 | AGAACCAGAAGAAGCAGGUGAGG | 166 | 558-580 |
| AD-1555117 | ACCUGCUUCUUCUGGUUCAUU | 41 | 562-582 | AAUGAACCAGAAGAAGCAGGUGA | 167 | 560-582 |
| AD-1555118 | CCUGCUUCUUCUGGUUCAUUU | 42 | 563-583 | AAAUGAACCAGAAGAAGCAGGUG | 168 | 561-583 |
| AD-1555120 | UGCUUCUUCUGGUUCAUUCUU | 43 | 565-585 | AAGAAUGAACCAGAAGAAGCAGG | 169 | 563-585 |
| AD-1555121 | GCUUCUUCUGGUUCAUUCUCU | 44 | 566-586 | AGAGAATGAACCAGAAGAAGCAG | 170 | 564-586 |
| AD-1555122 | CUUCUUCUGGUUCAUUCUCCU | 45 | 567-587 | AGGAGAAUGAACCAGAAGAAGCA | 171 | 565-587 |
| AD-1555123 | UUCUUCUGGUUCAUUCUCCAU | 46 | 568-588 | ATGGAGAAUGAACCAGAAGAAGC | 172 | 566-588 |
| AD-1555128 | CUGGUUCAUUCUCCAAAUCCU | 47 | 573-593 | AGGAUUTGGAGAAUGAACCAGAA | 173 | 571-593 |
| AD-1555184 | ACAGGGCCGAGUACGAAGUGU | 48 | 689-709 | ACACUUCGUACUCGGCCCUGUAG | 174 | 687-709 |
| AD-1555185 | CAGGGCCGAGUACGAAGUGGU | 49 | 690-710 | ACCACUUCGUACUCGGCCCUGUA | 175 | 688-710 |
| AD-1555212 | CCAGUGUGAAAGACAUAGCUU | 50 | 737-757 | AAGCTATGUCUUUCACACUGGCU | 176 | 735-757 |
| AD-1555213 | CAGUGUGAAAGACAUAGCUGU | 51 | 738-758 | ACAGCUAUGUCUUUCACACUGGC | 177 | 736-758 |
| AD-1555234 | AUUGAAUUCCACGCUGGGUUU | 52 | 759-779 | AAACCCAGCGUGGAAUUCAAUGC | 178 | 757-779 |
| AD-1555235 | UUGAAUUCCACGCUGGGUUGU | 53 | 760-780 | ACAACCCAGCGUGGAAUUCAAUG | 179 | 758-780 |
| AD-1555236 | UGAAUUCCACGCUGGGUUGUU | 54 | 761-781 | AACAACCCAGCGUGGAAUUCAAU | 180 | 759-781 |
| AD-1555238 | AAUUCCACGCUGGGUUGUUAU | 55 | 763-783 | ATAACAACCCAGCGUGGAAUUCA | 181 | 761-783 |
| AD-1555241 | UCCACGCUGGGUUGUUACCGU | 56 | 766-786 | ACGGTAACAACCCAGCGUGGAAU | 182 | 764-786 |
| AD-1555242 | CCACGCUGGGUUGUUACCGCU | 57 | 767-787 | AGCGGUAACAACCCAGCGUGGAA | 183 | 765-787 |
| AD-1555243 | CACGCUGGGUUGUUACCGCUU | 58 | 768-788 | AAGCGGTAACAACCCAGCGUGGA | 184 | 766-788 |
| AD-1555247 | CUGGGUUGUUACCGCUACAGU | 59 | 772-792 | ACUGTAGCGGUAACAACCCAGCG | 185 | 770-792 |
| AD-1555342 | GGGACCGACUGGCCAUGUAUU | 60 | 923-943 | AAUACAUGGCCAGUCGGUCCCGG | 186 | 921-943 |
| AD-1555343 | GGACCGACUGGCCAUGUAUGU | 61 | 924-944 | ACAUACAUGGCCAGUCGGUCCCG | 187 | 922-944 |
| AD-1555345 | ACCGACUGGCCAUGUAUGACU | 62 | 926-946 | AGUCAUACAUGGCCAGUCGGUCC | 188 | 924-946 |
| AD-1555346 | CCGACUGGCCAUGUAUGACGU | 63 | 927-947 | ACGUCATACAUGGCCAGUCGGUC | 189 | 925-947 |
| AD-1555348 | GACUGGCCAUGUAUGACGUGU | 64 | 929-949 | ACACGUCAUACAUGGCCAGUCGG | 190 | 927-949 |
| AD-1555349 | ACUGGCCAUGUAUGACGUGGU | 65 | 930-950 | ACCACGTCAUACAUGGCCAGUCG | 191 | 928-950 |
| AD-1555350 | CUGGCCAUGUAUGACGUGGCU | 66 | 931-951 | AGCCACGUCAUACAUGGCCAGUC | 192 | 929-951 |
| AD-1555366 | AGGCUCAUCACCUCGGUGUAU | 67 | 967-987 | ATACACCGAGGTGAUGAGCCUCU | 193 | 965-987 |
| AD-1555428 | GCCUGCACAGCUACUACGACU | 68 | 1061-1081 | AGUCGUAGUAGCUGUGCAGGCCC | 194 | 1059-1081 |
| AD-1555429 | CCUGCACAGCUACUACGACCU | 69 | 1062-1082 | AGGUCGUAGUAGCUGUGCAGGCC | 195 | 1060-1082 |
| AD-1555535 | CCUCUCUGGACUACGGCUUGU | 70 | 1235-1255 | ACAAGCCGUAGUCCAGAGAGGGC | 196 | 1233-1255 |
| AD-1555537 | UCUCUGGACUACGGCUUGGCU | 71 | 1237-1257 | AGCCAAGCCGUAGUCCAGAGAGG | 197 | 1235-1257 |
| AD-1555546 | UACGGCUUGGCCCUCUGGUUU | 72 | 1246-1266 | AAACCAGAGGGCCAAGCCGUAGU | 198 | 1244-1266 |
| AD-1555547 | ACGGCUUGGCCCUCUGGUUUU | 73 | 1247-1267 | AAAACCAGAGGGCCAAGCCGUAG | 199 | 1245-1267 |

TABLE 2-continued

Unmodified Sense and Antisense Strand Sequences of TMPRSS6 dsRNA Agents

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1555548 | CGGCUUGGCCCUCUGGUUUGU | 74 | 1248-1268 | ACAAACCAGAGGGCCAAGCCGUA | 200 | 1246-1268 |
| AD-1555549 | GGCUUGGCCCUCUGGUUUGAU | 75 | 1249-1269 | ATCAAACCAGAGGGCCAAGCCGU | 201 | 1247-1269 |
| AD-1555581 | GAGGAGGCAGAAGUAUGAUUU | 76 | 1281-1301 | AAAUCAUACUUCUGCCUCCUCAG | 202 | 1279-1301 |
| AD-1555583 | GGAGGCAGAAGUAUGAUUUGU | 77 | 1283-1303 | ACAAAUCAUACUUCUGCCUCCUC | 203 | 1281-1303 |
| AD-1555584 | GAGGCAGAAGUAUGAUUUGCU | 78 | 1284-1304 | AGCAAAUCAUACUUCUGCCUCCU | 204 | 1282-1304 |
| AD-1555585 | AGGCAGAAGUAUGAUUUGCCU | 79 | 1285-1305 | AGGCAAAUCAUACUUCUGCCUCC | 205 | 1283-1305 |
| AD-1555586 | GGCAGAAGUAUGAUUUGCCGU | 80 | 1286-1306 | ACGGCAAAUCAUACUUCUGCCUC | 206 | 1284-1306 |
| AD-1555587 | GCAGAAGUAUGAUUUGCCGUU | 81 | 1287-1307 | AACGGCAAAUCAUACUUCUGCCU | 207 | 1285-1307 |
| AD-1555588 | CAGAAGUAUGAUUUGCCGUGU | 82 | 1288-1308 | ACACGGCAAAUCAUACUUCUGCC | 208 | 1286-1308 |
| AD-1555589 | AGAAGUAUGAUUUGCCGUGCU | 83 | 1289-1309 | AGCACGGCAAATCAUACUUCUGC | 209 | 1287-1309 |
| AD-1555590 | GAAGUAUGAUUUGCCGUGCAU | 84 | 1290-1310 | ATGCACGGCAAAUCAUACUUCUG | 210 | 1288-1310 |
| AD-1555615 | CAGUGGACGAUCCAGAACAGU | 85 | 1318-1338 | ACUGUUCUGGAUCGUCCACUGGC | 211 | 1316-1338 |
| AD-1555616 | AGUGGACGAUCCAGAACAGGU | 86 | 1319-1339 | ACCUGUUCUGGAUCGUCCACUGG | 212 | 1317-1339 |
| AD-1555626 | CCAGAACAGGAGGCUGUGUGU | 87 | 1329-1349 | ACACACAGCCUCCUGUUCUGGAU | 213 | 1327-1349 |
| AD-1555628 | AGAACAGGAGGCUGUGUGGCU | 88 | 1331-1351 | AGCCACACAGCCUCCUGUUCUGG | 214 | 1329-1351 |
| AD-1555706 | UGUGCGGGUGCACUAUGGCUU | 89 | 1449-1469 | AAGCCAUAGUGCACCCGCACACC | 215 | 1447-1469 |
| AD-1555707 | GUGCGGGUGCACUAUGGCUUU | 90 | 1450-1470 | AAAGCCAUAGUGCACCCGCACAC | 216 | 1448-1470 |
| AD-1555709 | GCGGGUGCACUAUGGCUUGUU | 91 | 1452-1472 | AACAAGCCAUAGUGCACCCGCAC | 217 | 1450-1472 |
| AD-1555711 | GGGUGCACUAUGGCUUGUACU | 92 | 1454-1474 | AGUACAAGCCAUAGUGCACCCGC | 218 | 1452-1474 |
| AD-1555717 | ACUAUGGCUUGUACAACCAGU | 93 | 1460-1480 | ACUGGUUGUACAAGCCAUAGUGC | 219 | 1458-1480 |
| AD-1555723 | GCUUGUACAACCAGUCGGACU | 94 | 1466-1486 | AGUCCGACUGGUUGUACAAGCCA | 220 | 1464-1486 |
| AD-1555725 | CUGCCCUGGAGAGUUCCUCUU | 95 | 1488-1508 | AAGAGGAACUCUCCAGGGCAGGG | 221 | 1486-1508 |
| AD-1555768 | GCCUGGAUGAGAGAAACUGCU | 96 | 1565-1585 | AGCAGUUUCUCUCAUCCAGGCCG | 222 | 1563-1585 |
| AD-1555771 | UGGAUGAGAGAAACUGCGUUU | 97 | 1568-1588 | AAACGCAGUUUCUCUCAUCCAGG | 223 | 1566-1588 |
| AD-1555772 | GGAUGAGAGAAACUGCGUUUU | 98 | 1569-1589 | AAAACGCAGUUCUCUCAUCCAG | 224 | 1567-1589 |
| AD-1555776 | GAGAGAAACUGCGUUUGCAGU | 99 | 1573-1593 | ACUGCAAACGCAGUUUCUCUCAU | 225 | 1571-1593 |
| AD-1555789 | UUUGCAGAGCCACAUUCCAGU | 100 | 1586-1606 | ACUGGAAUGUGGCUCUGCAAACG | 226 | 1584-1606 |
| AD-1555894 | GUGGGACAUUCACCUUCCAGU | 101 | 1709-1729 | ACUGGAAGGUGAAUGUCCCACAU | 227 | 1707-1729 |
| AD-1555895 | UGGGACAUUCACCUUCCAGUU | 102 | 1710-1730 | AACUGGAAGGUGAAUGUCCCACA | 228 | 1708-1730 |
| AD-1555897 | GGACAUUCACCUUCCAGUGUU | 103 | 1712-1732 | AACACUGGAAGGUGAAUGUCCCA | 229 | 1710-1732 |
| AD-1555898 | GACAUUCACCUUCCAGUGUGU | 104 | 1713-1733 | ACACACTGGAAGGUGAAUGUCCC | 230 | 1711-1733 |
| AD-1555899 | ACAUUCACCUUCCAGUGUGAU | 105 | 1714-1734 | ATCACACUGGAAGGUGAAUGUCC | 231 | 1712-1734 |
| AD-1555900 | CAUUCACCUUCCAGUGUGAGU | 106 | 1715-1735 | ACUCACACUGGAAGGUGAAUGUC | 232 | 1713-1735 |
| AD-1556052 | AUCGCUGACCGCUGGGUGAUU | 107 | 1936-1956 | AAUCACCCAGCGGUCAGCGAUGA | 233 | 1934-1956 |
| AD-1556057 | UGACCGCUGGGUGAUAACAGU | 108 | 1941-1961 | ACUGUUAUCACCCAGCGGUCAGC | 234 | 1939-1961 |
| AD-1556126 | CGUGUUCCUGGGCAAGGUGUU | 109 | 2010-2030 | AACACCUUGCCCAGGAACACGGU | 235 | 2008-2030 |
| AD-1556127 | GUGUUCCUGGGCAAGGUGUGU | 110 | 2011-2031 | ACACACCUUGCCCAGGAACACGG | 236 | 2009-2031 |

TABLE 2-continued

Unmodified Sense and Antisense Strand Sequences of TMPRSS6 dsRNA Agents

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1556137 | GCAAGGUGUGGCAGAACUCGU | 111 | 2021-2041 | ACGAGUUCUGCCACACCUUGCCC | 237 | 2019-2041 |
| AD-1556139 | AAGGUGUGGCAGAACUCGCGU | 112 | 2023-2043 | ACGCGAGUUCUGCCACACCUUGC | 238 | 2021-2043 |
| AD-1556163 | CUGGAGAGGUGUCCUUCAAGU | 113 | 2048-2068 | ACUUGAAGGACACCUCUCCAGGC | 239 | 2046-2068 |
| AD-1556164 | UGGAGAGGUGUCCUUCAAGGU | 114 | 2049-2069 | ACCUTGAAGGACACCUCUCCAGG | 240 | 2047-2069 |
| AD-1556166 | GAGAGGUGUCCUUCAAGGUGU | 115 | 2051-2071 | ACACCUUGAAGGACACCUCUCCA | 241 | 2049-2071 |
| AD-1556167 | AGAGGUGUCCUUCAAGGUGAU | 116 | 2052-2072 | ATCACCUUGAAGGACACCUCUCC | 242 | 2050-2072 |
| AD-1556319 | AUCCCACAGGACCUGUGCAGU | 117 | 2299-2319 | ACUGCACAGGUCCUGUGGGAUCA | 243 | 2297-2319 |
| AD-1556359 | UGACGCCACGCAUGCUGUGUU | 118 | 2339-2359 | AACACAGCAUGCGUGGCGUCACC | 244 | 2337-2359 |
| AD-1556360 | GACGCCACGCAUGCUGUGUGU | 119 | 2340-2360 | ACACACAGCAUGCGUGGCGUCAC | 245 | 2338-2360 |
| AD-1556382 | GCUACCGCAAGGGCAAGAAGU | 120 | 2363-2383 | ACUUCUUGCCCUUGCGGUAGCCG | 246 | 2361-2383 |
| AD-1556383 | CUACCGCAAGGGCAAGAAGGU | 121 | 2364-2384 | ACCUUCUUGCCCUUGCGGUAGCC | 247 | 2362-2384 |
| AD-1556465 | GGCCUAACUACUUCGGCGUCU | 122 | 2483-2503 | AGACGCCGAAGUAGUUAGGCCGG | 248 | 2481-2503 |
| AD-1556466 | GCCUAACUACUUCGGCGUCUU | 123 | 2484-2504 | AAGACGCCGAAGUAGUUAGGCCG | 249 | 2482-2504 |
| AD-1556484 | CUACACCCGCAUCACAGGUGU | 124 | 2502-2522 | ACACCUGUGAUGCGGGUGUAGAC | 250 | 2500-2522 |
| AD-1556510 | GCUGGAUCCAGCAAGUGGUGU | 125 | 2528-2548 | ACACCACUUGCUGGAUCCAGCUG | 251 | 2526-2548 |
| AD-1556584 | UGGCAGGAGGUGGCAUCUUGU | 126 | 2670-2690 | ACAAGAUGCCACCUCCUGCCACC | 252 | 2668-2690 |
| AD-1556585 | GGCAGGAGGUGGCAUCUUGUU | 127 | 2671-2691 | AACAAGAUGCCACCUCCUGCCAC | 253 | 2669-2691 |
| AD-1556586 | GCAGGAGGUGGCAUCUUGUCU | 128 | 2672-2692 | AGACAAGAUGCCACCUCCUGCCA | 254 | 2670-2692 |
| AD-1556587 | CAGGAGGUGGCAUCUUGUCUU | 129 | 2673-2693 | AAGACAAGAUGCCACCUCCUGCC | 255 | 2671-2693 |
| AD-1556613 | UGAUGUCUGCUCCAGUGAUGU | 130 | 2699-2719 | ACAUCACUGGAGCAGACAUCAGG | 256 | 2697-2719 |
| AD-1556677 | CAAUUCUCUCUCCUCCGUCCU | 131 | 2801-2821 | AGGACGGAGGAGAGAGAAUUGGG | 257 | 2799-2821 |
| AD-1556709 | GGCUCAGCAGCAAGAAUGCUU | 132 | 2853-2873 | AAGCAUUCUUGCUGCUGAGCCAC | 258 | 2851-2873 |
| AD-1556710 | GCUCAGCAGCAAGAAUGCUGU | 133 | 2854-2874 | ACAGCAUUCUUGCUGCUGAGCCA | 259 | 2852-2874 |
| AD-1556789 | CUGGUCUAACUUGGGAUCUGU | 134 | 2973-2993 | ACAGAUCCCAAGUUAGACCAGGG | 260 | 2971-2993 |
| AD-1556790 | UGGUCUAACUUGGGAUCUGGU | 135 | 2974-2994 | ACCAGAUCCCAAGUUAGACCAGG | 261 | 2972-2994 |
| AD-1556791 | GGUCUAACUUGGGAUCUGGGU | 136 | 2975-2995 | ACCCAGAUCCCAAGUUAGACCAG | 262 | 2973-2995 |
| AD-1556795 | UAACUUGGGAUCUGGGAAUGU | 137 | 2979-2999 | ACAUUCCCAGAUCCCAAGUUAGA | 263 | 2977-2999 |
| AD-1556799 | UUGGGAUCUGGGAAUGGAAGU | 138 | 2983-3003 | ACUUCCAUUCCCAGAUCCCAAGU | 264 | 2981-3003 |
| AD-1556802 | GGAUCUGGGAAUGGAAGGUGU | 139 | 2986-3006 | ACACCUUCCAUUCCCAGAUCCCA | 265 | 2984-3006 |
| AD-1556908 | UGAGCUCAGCUGCCCUUGGU | 140 | 3158-3178 | ACCAAAGGGCAGCUGAGCUCACC | 266 | 3156-3178 |
| AD-1556909 | GAGCUCAGCUGCCCUUUGGAU | 141 | 3159-3179 | ATCCAAAGGGCAGCUGAGCUCAC | 267 | 3157-3179 |
| AD-1556911 | GCUCAGCUGCCCUUUGGAAUU | 142 | 3161-3181 | AAUUCCAAAGGGCAGCUGAGCUC | 268 | 3159-3181 |
| AD-1556915 | AGCUGCCCUUUGGAAUAAAGU | 143 | 3165-3185 | ACUUUAUCCAAAGGGCAGCUGA | 269 | 3163-3185 |
| AD-1556917 | CUGCCCUUUGGAAUAAAGCUU | 144 | 3167-3187 | AAGCUUUAUUCCAAAGGGCAGCU | 270 | 3165-3187 |
| AD-1556918 | UGCCCUUUGGAAUAAAGCUGU | 145 | 3168-3188 | ACAGCUUUAUUCCAAAGGGCAGC | 271 | 3166-3188 |

TABLE 3

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1554875 | gscscuguagGfgAfcuccaagaguL96 | 272 | asdCsucdTuddgagudCcUfcacaggcscsu | 398 | AGGCCUGUGAGGACUCCAAGAGA | 524 |
| AD-1554909 | gsgsugcuacUfCfUfGfguauuuccuuL96 | 273 | asdGsgadAadTaccadGaGfuagcaccscsc | 399 | GGGGUGCUACUCCUGGUAUUUCCU | 525 |
| AD-1554910 | gsusgcuacuCfUfGfGfuauuuccuuL96 | 274 | asdAsggdAadAuaccdAgAfguagcacscsc | 400 | GGGUGCUACUCCUGGUAUUUCCUA | 526 |
| AD-1554911 | usgscuacucUfGfGfuauuuccuauL96 | 275 | asdTsagdGadAauacdCaGfaguagcascsc | 401 | GGUGCUACUCCUGGUAUUUCCUAG | 527 |
| AD-1554912 | gsusuacucuGfGfUfauuuccuaguL96 | 276 | asdCsuacdGgdAaauadCcAfagauagcsasc | 402 | GUGCUACUCCUGGUAUUUCCUAGG | 528 |
| AD-1554913 | csusacucugGfUfAfuuuccuagguL96 | 277 | asdCscudAgdGaaaudAcCfagauagcsasa | 403 | UGCUACUCCUGGUAUUUCCUAGGG | 529 |
| AD-1554914 | usasucucugGfUfAfUfuccuagguuL96 | 278 | asdCsccdTaddGaaadTaCfcagauasgsc | 404 | GCUACUCCUGGUAUUUCCUAGGGU | 530 |
| AD-1554915 | ascsucuggaUfAfUfUfuccuaggguL96 | 279 | asdAsccdCudAggaadAuAfccagagusasg | 405 | CUACUCCUGGUAUUUCCUAGGGUA | 531 |
| AD-1554916 | csuscuguaUfUfUfCfccuagggauL96 | 280 | asdTsaccdCcdTaggadAaAfuaccagagsusa | 406 | UACUCCUGGUAUUUCCUAGGGUAC | 532 |
| AD-1554917 | uscsuguauUfUfCfCfcuagggauL96 | 281 | asdGsuacdCcdCuaggdAaAfuaccagasgsu | 407 | ACUCCUGGUAUUUCCUAGGGUACA | 533 |
| AD-1554923 | asusuuccuaGfGfGfuacaaggcguL96 | 282 | asdCsgcdCudTguacdCcUfaggaaausasc | 408 | GUAUUUCCUAGGGUACAAGGCGG | 534 |
| AD-1554951 | gsgsucagcaGfGfUfguacucuaggL96 | 283 | asdCsugdAgdTacacdCuGfcugaccsasu | 409 | AUGGUCAGCCAGGUGUACUCAGG | 535 |
| AD-1554955 | asgsccaggUfGfAfcucaggcagruL96 | 284 | asdCsugdCaggdCcdTgagudAcAfccuggcusgsa | 410 | UCAGCCAGGUGUACUCCAGGCAGU | 536 |
| AD-1554992 | gscscuucCfCfAfcucccaggaucuuuL96 | 285 | asdCscacdCcdTuaggdAaAfuaccagasgsu | 411 | UCGCCACUCCCCAGGAUCUUA | 537 |
| AD-1554997 | usustcuccaGfGfAfucuuacccguL96 | 286 | asdCsggdGudAagaudCcUfgggagaasgsu | 412 | ACUUCCCAGGAUCUUACCCGC | 538 |
| AD-1555000 | uscscccaggaUfCfUfuaccgcgcuL96 | 287 | asdCsgggdCgdGuaadGaUfccuggasgsa | 413 | UCUCCCAGGAUCUUACCCGCGG | 539 |
| AD-1555030 | gscscuccgGfCfAfGfguaaaccguL96 | 288 | asdGscgdGfGudTucacdTgCfggaaggcsasc | 414 | GUGCCUUCCGCAGUGAAACCGCC | 540 |
| AD-1555106 | csasasuccaGfCfUfCfcgucuauuuL96 | 289 | asdAsaudAgdAcgadGcUfgagguugsusa | 415 | UACAACUCCAGCUCCGUCUAUUC | 541 |
| AD-1555112 | csasgcccgUfCfCfUfauuccuuguL96 | 290 | asdCsaadAgdAauadGaCfggagcugsgsa | 416 | UCCAGCUCCGUCUAUUCCUUGG | 542 |
| AD-1555114 | csuscaccugCfUfCfCfuucuguuuL96 | 291 | asdAsaccdCadGaagadAgCfaggugasgsg | 417 | CCCUCACCUGCUUCUUCUGGUC | 543 |
| AD-1555115 | uscsaccugCfUfUfCfuucuguucuL96 | 292 | asdGsaadAadCcagadAaGfcaggugasgsg | 418 | CCUCACCUGCUUCUUCUGGUCA | 544 |
| AD-1555117 | ascsccugCfUfUfCfucuggucauL96 | 293 | asdAsugdAadCcagadAgAfagcaggusgsa | 419 | UCACCUGCUUCUUCUGGUCAUU | 545 |
| AD-1555118 | cscsgucuuCfUfGfGfuccaucauuL96 | 294 | asdAsaudGadAccagdAaGfaagcaggsusg | 420 | CACCUGCUUCUUCUGGUCAUUC | 546 |
| AD-1555120 | usgscuucuCfUfGfguucaucucuL96 | 295 | asdAsgadAudGaaccdAgAfagaagcasgsg | 421 | CCUGCUUCUUCUGGUCAUUCUC | 547 |

TABLE 3-continued

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1555121 | gscsuucuucUfGfGfuucauucucucuL96 | 296 | asdGsagdAadTgaacdCaGfaagaagcsasg | 422 | CUGCUUCUUCUGGUUCAUUCUCC | 548 |
| AD-1555122 | csusucuucuGfGfUfucauucuccauL96 | 297 | asdGsgadGadAugaadCcAfgaagaagcsa | 423 | UGCUUCUUCUGGUUCAUUCUCCA | 549 |
| AD-1555123 | ususucuucugGfUfUfcauucuccaaL96 | 298 | asdTsggdGfAgdAaugadAcCfagaagaasgsc | 424 | GCUUCUUCUGGUUCAUUCUCCAA | 550 |
| AD-1555128 | csusgguucaUfUfCfuccaaauccuL96 | 299 | asdGsgadTudTggagdAaUfgaaccagsasa | 425 | UUCUGGUUCAUUCUCCAAAUCCC | 551 |
| AD-1555184 | ascsagggccGfAfGfuacgaagugcuL96 | 300 | asdCsacdTudCguacdTcGfgcccugusasg | 426 | CUACAGGGCCGAGUACGAAGUGG | 552 |
| AD-1555185 | csasgggccgAfGfUfacgaagugguL96 | 301 | asdCscacdCudTcguadCuCfgcccugsusa | 427 | UACAGGGCCGAGUACGAAGUGGA | 553 |
| AD-1555212 | cscsagugugAfAfAfgacauagcuuL96 | 302 | asdAsgcdTadTgucudTuCfcacacuggscsu | 428 | AGCCAGUGUGAAAGACAUAGCUG | 554 |
| AD-1555213 | csasgugugaAfAfAfgacauagcuguL96 | 303 | asdCsagdCudAugucdTuUfcacacugsgsc | 429 | GCCAGUGUGAAAGACAUAGCUGC | 555 |
| AD-1555234 | asusugaauuCfAfCfgcuggguuuL96 | 304 | asdAsacdCcdAgcgudGgAfaauucaausgsc | 430 | GCAUUGAAUUCCACGCUGGGUUG | 556 |
| AD-1555235 | ususugaauucAfCfCfgcugggugguuL96 | 305 | asdCsacdCcdAgcgdTgGfaauucasusgu | 431 | CAUUGAAUUCCACGCUGGGUUGU | 557 |
| AD-1555236 | usgsaauuccAfCfGfcuggguugguuL96 | 306 | asdAscadAcdCcagcGfcGfGfgaaucasasu | 432 | AUUGAAUUCCACGCUGGGUUGUU | 558 |
| AD-1555238 | asasuuccacGfCfUfUfgggugguuauL96 | 307 | asdTsaacdCadAccdcadGcGfuggaauuscsa | 433 | UGAAUUCCACGCUGGGUUGUUAC | 559 |
| AD-1555241 | uscscacgcuGfGfGfuuguuaccguL96 | 308 | asdCsggdTadAcaacdCcAfgcgugggasasu | 434 | AUUCCACGCUGGGUUGUUACCGC | 560 |
| AD-1555242 | cscsacgcugGfGfUfuguuaccgcuL96 | 309 | asdGscgdGudAacaadCcCfagcguggsasa | 435 | UUCCACGCUGGGUUGUUACCGCU | 561 |
| AD-1555243 | csascgcuggGfUfUfguuaccgcuaL96 | 310 | asdAsgcdGgdTaacadAcCfcagcgugsgsa | 436 | UCCACGCUGGGUUGUUACCGCUA | 562 |
| AD-1555247 | csusggguugUfUfAfccgcucagucL96 | 311 | asdCsugdTadGcggudAaCfaaccagscsg | 437 | CGCUGGGUUGUUACCGCUACAGC | 563 |
| AD-1555342 | gsgsgaccgaCfUfGfgccauguauuL96 | 312 | asdAsuadCadTggccdAgUfcggucccsgsg | 438 | CCGGGACCGACUGGCCAUGUAUG | 564 |
| AD-1555343 | gsgsaccgacUfGfGfccauguaugL96 | 313 | asdCsaudAcdAuggccdCaGfucgguccsgsc | 439 | CGGGACCGACUGGCCAUGUAUGA | 565 |
| AD-1555345 | ascscgacugGfCfCfaugguaugacuL96 | 314 | asdGsuccdAudAcaugdGcCfagguccgsc | 440 | GGACCGACUGGCCAUGUAUGACG | 566 |
| AD-1555346 | cscsgacuggCfCfAfuguaugacguL96 | 315 | asdCsgudCadTacaudGgCfcagucggsusc | 441 | GACCGACUGGCCAUGUAUGACGU | 567 |
| AD-1555348 | gsascuggccAfUfGfuaugacguggL96 | 316 | asdCsacdGfUcdCauacdAuGfgccagucsgsg | 442 | CCGACUGGCCAUGUAUGACGUGG | 568 |
| AD-1555349 | ascsuggccaUfGfUfaugacguggguL96 | 317 | asdCscadCgdTcauadCaUfggccagucsg | 443 | CGACUGGCCAUGUAUGACGUGGC | 569 |
| AD-1555350 | csusggccauGfUfAfugacguggccL96 | 318 | asdGsccdAcdGucaudAcAfuggccagsusc | 444 | CGACUGGCCAUGUAUGACGUGGCC | 570 |
| AD-1555366 | asgsgcucauCfAfCfcucggugguauL96 | 319 | asdTsacdAcdCgaggdTgAfagagcuscsu | 445 | AGAGGCUCAUCACCUCGGUGUAC | 571 |

TABLE 3-continued

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1555428 | gscscugcacAfGfCfuacuacgacuL96 | 320 | asdGsucdGudAsguagdCuGfugcaggcscsc | 446 | GGGCCUGCAAGCUACUACGACC | 572 |
| AD-1555429 | csccugcacaGfCfUfacuacgaccuL96 | 321 | asdGsgudCgdTaguadGcUfgugcaggscsc | 447 | GGCCUGCACAGCUACUACGACCC | 573 |
| AD-1555535 | cscsucucugGfAfCfuacggcuuguL96 | 322 | asdCsaacdGcdCguagdTcCfagagaggsgsc | 448 | GCCCUCUGGACUACGGCUUGG | 574 |
| AD-1555537 | uscsucuggaCfUfAfcggcuuggcuL96 | 323 | asdGscccdAadGccgudAgUfccagagasgsg | 449 | CCUCUGGACUACGGCUUGCC | 575 |
| AD-1555546 | uaascggcuugUfGfCfccucugguuuL96 | 324 | asdAsaacdCadGagggdCcAfagcguasgsu | 450 | ACUACGGCUUGCCCUCUGGUUU | 576 |
| AD-1555547 | ascsggcuugGfCfCfcucugguuuuL96 | 325 | asdAsaadCcdAgaggdGcCfaagccguasg | 451 | CUACGGCUUGCCCUCUGGUUUG | 577 |
| AD-1555548 | csggcuuggCfCfCfucugguuuguL96 | 326 | asdCsaadAcdCagagdGgCfcaagccgusa | 452 | UACGGCUUGCCCUCUGGUUUGA | 578 |
| AD-1555549 | gggcuuggcCfCfUfcugguuugauL96 | 327 | asdCsuggCfCfUfcugguuugauuuL96 alt—asdTscadAadCcagadGgGfccaagccsgsu | 453 | ACGGCUUGCCCUCUGGUUUGAU | 579 |
| AD-1555581 | gsasggaggcAfGfAfguaugauuuL96 | 328 | asdAsaudCadTacuudCuGfccuccuucsasg | 454 | CUGAGAGGCAGAAGUAUGAUUU | 580 |
| AD-1555583 | gggsaggcagAfGfAfguaugauuugL96 | 329 | asdCsaadAudCauadCuUfcugccuccsusc | 455 | GAGGAGGCAGAAGUAUGAUUGCC | 581 |
| AD-1555584 | gsasggcagaAfGfUfauaugauuugcL96 | 330 | asdCsgcadAaudTcAfauacuuccsusc | 456 | AGGAGGCAGAAGUAUGAUUUGCC | 582 |
| AD-1555585 | asgsgcagaaGfUfAfugauaugauuugccuL96 | 331 | asdGsgcdAadAucaudAcUfucugccsasc | 457 | GGAGGCAGAAGUAUGAUUUGCCG | 583 |
| AD-1555586 | gggscagaagUfAfUfgauuugccguL96 | 332 | asdCsggdCadAaucadTaCfuucugccsusc | 458 | GAGGCAGAAGUAUGAUUUGCCGU | 584 |
| AD-1555587 | gscsagaaguAfUfGfauuugccguuL96 | 333 | asdAscgdGcdAaaucdAuAfcuucugcscsu | 459 | AGGCAGAAGUAUGAUUUGCCGUG | 585 |
| AD-1555588 | csasgaaguauGfAfUfuugccgucL96 | 334 | asdCsacdGgdCaaaudCaUfacuucugscsc | 460 | GGCAGAAGUAUGAUUUGCCGUGC | 586 |
| AD-1555589 | asgsaaguaugAfUfUfugccgugcauL96 | 335 | asdGscadCgdGcaaadTcAfuacuuucgsc | 461 | GCAGAAGUAUGAUUUGCCGUGCA | 587 |
| AD-1555590 | gsasaguaugaUfUfUfgccgugcauL96 | 336 | asdTsgcdAcdGgcaadAuCfauacuucsusg | 462 | CAGAAGUAUGAUUUGCCGUGCAC | 588 |
| AD-1555615 | csasgugaccAfUfCfcagaacaguL96 | 337 | asdCsugdTudCuggdaTcGfuccacusgsg | 463 | GCCAGUGGACCAUCCAGAACAGG | 589 |
| AD-1555616 | asgsguggacAfUfCfcagaacaagguL96 | 338 | asdCscudGudTcuggdAuCfguccacusgsg | 464 | CCAGUGGACCAUCCAGAACAGGA | 590 |
| AD-1555626 | cscsagaacaGfUfAfggcuguguggL96 | 339 | asdCsacdAcdAcagcdCcUfguucugusgsu | 465 | AUCCAGAACAGGAGGCUGUGUGG | 591 |
| AD-1555628 | asgsgaacaggAfGfGfcuguguggcuL96 | 340 | asdGsccdAcdAcagcdCuCfcuguucugsg | 466 | CCAGAACAGGAGGCUGUGUGGCU | 592 |
| AD-1555706 | ugsugcgggUfGfCfacuauggcuuL96 | 341 | asdAsagcdCcdAuaugdGcAfcccgcacsasc | 467 | GGUGCGGGUGCACUAUGGCUU | 593 |
| AD-1555707 | gsusgcggguGfCfAfcuauggcuuL96 | 342 | asdAsagcdCcdAuaugdGcAfcccgcacsasc | 468 | GUGCGGGUGCACUAUGGCUUG | 594 |
| AD-1555709 | gscsgggugcAfCfUfauggcuuguL96 | 343 | asdAscadAgdCcauadGuGfcacccgsasc | 469 | GUGCGGGUGCACUAUGGCUUGUA | 595 |
| AD-1555711 | gsgsgugcacUfAfUfggcuuguacuL96 | 344 | asdGsuadCadAgccadTaGfugcaccesgsc | 470 | GCGGGUGCACUAUGGCUUGUACA | 596 |

TABLE 3-continued

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1555717 | ascsuauggcUfUfGfuacaaccaguL96 | 345 | asdCsugdGudTguacdAaGfccauagusgsc | 471 | GCACUAUGGCUUGUACAACCAGU | 597 |
| AD-1555723 | gscsuuguacAfAfCfcaguccgacuL96 | 346 | asdGsucdCgdAcuggdTuGfuacaagcscsa | 472 | UGGCUUGUACAACCAGUCGACC | 598 |
| AD-1555725 | csusgcccugGfAfGfaguuccucuuL96 | 347 | asdAsgadGgdAacucdTcCfagggcagsgsg | 473 | CCCUGCCCUGGAGAGUUCCUCUG | 599 |
| AD-1555768 | gscscuggauGfAfGfagaaacugcuL96 | 348 | asdGscadGudTucucdTcAfuccaggcscsg | 474 | CGGCCUGGAUGAGAGAAACUGCG | 600 |
| AD-1555771 | ugsgsgaugagAfGfAfaacugcguuuL96 | 349 | asdAsacdGcdAguuudCuCfucauccasgsg | 475 | CCUGGAUGAGAGAAACUGCGUUU | 601 |
| AD-1555772 | gsgsaugagaGfAfAfacugcguuuuL96 | 350 | asdAsaadCgdCaguudTcUfcucauccsasg | 476 | CUGGAUGAGAGAAACUGCGUUUG | 602 |
| AD-1555776 | gsasgagaaaCfUfGfcguuugcaguL96 | 351 | asdCsugdCadAacgcdAgUfuucucucsasu | 477 | AUGAGAGAAACUGCGUUUGCAGA | 603 |
| AD-1555789 | ususugcagaGfCfCfacauuccaguL96 | 352 | asdCsugdGadAugugdCcUfcugcaaascsg | 478 | CGUUUGCAGAGCCACAUUCCAGU | 604 |
| AD-1555894 | gsusgsggacaUfUfCfaccuuccaguL96 | 353 | asdCsugdGadAggugdAaUfguccacasasu | 479 | AUGUGGGACAUUCACCUUCCAGU | 605 |
| AD-1555895 | usgsggggacaUfUfCfAfccuuccaguuL96 | 354 | asdAscudGgdAaggudGaAfuguccascsa | 480 | UGUGGGACAUUCACCUUCCAGUG | 606 |
| AD-1555897 | gsgsacauucAfCfCfuUfuccagugauL96 | 355 | asdAscadCudGgaadGgUfgaaugucscsc | 481 | GGGACAUUCACCUUCCAGUGUUG | 607 |
| AD-1555898 | gsascauucaCfCfUfUfccagugugaL96 | 356 | asdCsacdAcdTggaadGgUfgaaugucscsc | 482 | GGACAUUCACCUUCCAGUGUGA | 608 |
| AD-1555899 | ascsauucacCfUfUfccagugugauL96 | 357 | asdTscadCadCuggadAgGfugaaugusscsc | 483 | GACAUUCACCUUCCAGUGUGAG | 609 |
| AD-1555900 | csasuuccacCfUfUfCfcagugugagL96 | 358 | asdCsucdAcdAcuggdAaGfgugaaugsusc | 484 | ACAUUCACCUUCCAGUGUGAGG | 610 |
| AD-1556052 | asuscgcugaCfCfGfcuggguagauL96 | 359 | asdAsucdAcdCcagcGgUfcagcgausgsa | 485 | UCAUCGCUGACCGCUGGGUAUA | 611 |
| AD-1556057 | ugsgsaccgcUfGfGfugauaacaguL96 | 360 | asdCsugdTudAucacdCcAfgcggucasgsc | 486 | GCUGACCGCUGGGUGAUAACAGC | 612 |
| AD-1556126 | csgsguguccUfGfGfgcaaggugguL96 | 361 | asdAscadCcdTugccdCaGfgaacacgsgsu | 487 | ACCGUGUUCCUGGGCAAGGUGUG | 613 |
| AD-1556127 | gsusguuccuGfGfGfcaaggugugL96 | 362 | asdCsacdAcdCuugcdCcAfggaacacgsgsg | 488 | CCGUGUUCCUGGGCAAGGUGUGG | 614 |
| AD-1556137 | gscsaaggugUfGfCfagaacucguL96 | 363 | asdCsgadGudTcugcdCaCfaccuugscscsc | 489 | GGGCAAGGUGUGGCAGAACUCGC | 615 |
| AD-1556139 | asasggugUfGfCfAfgaacucgcguL96 | 364 | asdCsgcdGadGuucudGcCfaccuusgsc | 490 | GCAAGGUGUGGCAGAACUCCGC | 616 |
| AD-1556163 | csusggagagGfUfGfuccuucaaguL96 | 365 | asdCsuudGadAggacdAcCfucuccagsgsc | 491 | GCCUGGAGAGGUGUCCUUCAAGG | 617 |
| AD-1556164 | ugsgsagaggUfGfUfccuucaagguL96 | 366 | asdCscudTgdAaggadCaCfucuccasgsg | 492 | CCUGGAGAGGUGUCCUUCAAGGU | 618 |
| AD-1556166 | gsasgaggugUfCfCfuucaagguguL96 | 367 | asdCsacdCudTgaadGaCfaccucscsa | 493 | UGGAGAGGUGUCCUUCAAGGUGA | 619 |
| AD-1556167 | agsgsaggugUfCfUfucaagguguL96 | 368 | asdTscadCcdTugaadGaAfcaccucscsc | 494 | GGAGAGGUGUCCUUCAAGGUGAG | 620 |

TABLE 3-continued

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1556319 | asusccacaGfAfAfccugugcaguL96 | 369 | asdCsugdCadCaggudCcUfguggdaguscsa | 495 | UGAUCCCACAGGACCUGUGCAGC | 621 |
| AD-1556359 | usggacgccacCfGfCfaugcuguguuL96 | 370 | asdAscadCadGcaugdCgUfggcgucascsc | 496 | GGUGACGCCACGCAUGCUGUGUG | 622 |
| AD-1556360 | gasacgccacGfCfAfugcugugugguL96 | 2331 | asdCsacdAcdAgcaudGcGfuggcgucasasc | 497 | GUGACGCCACGCAUGCUGUGUGC | 623 |
| AD-1556382 | gcsuaccgcAfAfGfggcaagaaguL96 | 372 | asdCsuudCudTgcccdTuGfcgguagcscsg | 498 | CGGCUACCGCAAGGGCAAGAAGG | 624 |
| AD-1556383 | csusaccgcaAfGfGfgcaagaagguL96 | 373 | asdCscudTcdTugccdCuUfcgguagscsc | 499 | GGCUACCGCAAGGGCAAGAAGGA | 625 |
| AD-1556465 | gsgsccuaacUfAfCfuucggcgucuL96 | 374 | asdGsacdGcdCgaagdTaGfuuaggcscsg | 500 | CCGGCUAACUACUUCGGCGUCU | 626 |
| AD-1556466 | gcscuaacuAfCfUfucggcgucuuL96 | 375 | asdAsgadCgdCcgaadGuAfguuaggcscsg | 501 | CGGCUAACUACUUCGGCGUCUA | 627 |
| AD-1556484 | csusacacccGfCfAfucacaguguL96 | 376 | asdCsacdCudGuguadGcGfgguuagascsc | 502 | GUCUACACCCGCAUCACAGGUGU | 628 |
| AD-1556510 | gcsugaucCfAfGfcaagugugaL96 | 377 | asdCsacdCadCuugcdTgGfauccagscsug | 503 | CAGCUGGAUCCAGCAAGUGUGA | 629 |
| AD-1556584 | usgsgcaggaGfGfUfggcaucuuguL96 | 378 | asdCsaadGadTgccadCcUfccugccascsc | 504 | GGUGGCAGGAGGUGGCAUCUGU | 630 |
| AD-1556585 | gsgscaggagGfGfUfGfggcaucuuguL96 | 379 | asdAscadAgdAgucccdAcCfuccugccasasc | 505 | GUGGCAGGAGGUGGCAUCUGUC | 631 |
| AD-1556586 | gcsaggaggUfGfGfcaucugucuL96 | 380 | asdGsacdAadGaugcdCaCfuccugcscsa | 506 | UGGCAGGAGGUGGCAUCUGUCU | 632 |
| AD-1556587 | csaaggagguGfGfCfaucuugucuuL96 | 381 | asdAsgadCadAgaugdCCAfccuccugscsc | 507 | GGCAGGAGGUGGCAUCUGUCUC | 633 |
| AD-1556613 | usggsaugucuGfCfUfCfcagugauguL96 | 382 | asdCsaudCadCuggadGcAfgacaucasgsg | 508 | CCUGAUGUCUGCUCCAGUGAUGG | 634 |
| AD-1556677 | csasauucucUfCfUfccuccgucuL96 | 383 | asdGsgadCgdGaggadGaGfagaauugsgsg | 509 | CCCAAUUCUCUCUCCCGUCCC | 635 |
| AD-1556709 | gsgscucagcAfGfCfaagaaugcuL96 | 384 | asdCsagcdAudTcuugdCuGfcugagcscsac | 510 | GUGGCUCAGCAGCAAGAAUGCUG | 636 |
| AD-1556710 | gcscucagcaGfCfAfagaaugcuL96 | 385 | asdCsagdCadTucuudGcUfgcugagscsa | 511 | UGGCUCAGCAGCAAGAAUGCUGG | 637 |
| AD-1556789 | csusgguucuaAfcfUfugggaucuL96 | 386 | asdCsagdAudCcccadGuUfagaccasgsg | 512 | CCCUGGUCUAACUUGGGAUCUGG | 638 |
| AD-1556790 | usgsgucuaaCfUfUfgggaucugguL96 | 387 | asdCscadGadTccadAgUfuagaccasgsg | 513 | CCUGGUCUAACUUGGGAUCUGGG | 639 |
| AD-1556791 | gsgsucuaacUfUfGfggaucugguL96 | 388 | asdCsccdAgdAuccdAaGfuuagaccasgsg | 514 | CUGGUCUAACUUGGGAUCUGGGA | 640 |
| AD-1556795 | usasacuuggGfAfUfcugggaauguL96 | 389 | asdCsaudTcdCcagadTcCfcaaguuasgsa | 515 | UCUAACUUGGGAUCUGGGAAUGG | 641 |
| AD-1556799 | ususgggaucUfGfGfgaauggaagguL96 | 390 | asdCsuudCcdAuucdCaGfauccccasgsu | 516 | ACUUGGGAUCUGGGAAUGGAAGG | 642 |
| AD-1556802 | gsgsaucuggGfAfUfuggaauggaguL96 | 391 | asdCscadCudTccaudTcCfcagauccscsa | 517 | UGGGAUCUGGGAAUGGAAGUGC | 643 |
| AD-1556908 | usgsagcucaGfCfUfgcccuuuggauL96 | 392 | asdCscadAadGggcadGcUfgagcucascsc | 518 | GGUGAGCUCAGCUGCCCUUUGGA | 644 |
| AD-1556909 | gsasgcucagCfUfGfcccuuuggauL96 | 393 | asdTsccdAadAgggcdAgCfugagcucsasc | 519 | GUGAGCUCAGCUGCCCUUUGGAA | 645 |

TABLE 3-continued

Modified Sense and Antisense Strand Sequences of TMPRSS6 dsRNA Agents

| Duplex Name | Sense Sequence 5' to 3' | SEQ ID NO. | Antisense Sequence 5' to 3' | SEQ ID NO. | mRNA target sequence 5' to 3' | SEQ ID NO. |
|---|---|---|---|---|---|---|
| AD-1556911 | gscsucagcuGfCfCfcuuuggaauuL96 | 394 | asdAsuudCcdAaaggdGcAfgcugagcsusc | 520 | GAGCUCAGCUGCCCUUUGGAAUA | 646 |
| AD-1556915 | asgcugcccUfUfUfggaauaaaguL96 | 395 | asdCsuudTadTuccadAaGfggcagcusgsa | 521 | UCAGCUGCCCUUUGGAAUAAAGC | 647 |
| AD-1556917 | csusgcccuuUfGfGfaauaaagcuuL96 | 396 | asdAsgcdTudTauucdCaAfagggcagscsu | 522 | AGCUGCCCUUUGGAAUAAAGCUG | 648 |
| AD-1556918 | usgscccuuuGfGfAfauaaagcugL96 | 397 | asdCsagdCudTuauudCcAfaagggcasgsc | 523 | GCUGCCCUUUGGAAUAAAGCUGC | 649 |

TABLE 4

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1557376 | CGGAGGUGAUGGCGAGGAAGU | 650 | 189-209 | ACUUCCUCGCCAUCACCUCCGUC | 848 | 187-209 |
| AD-1557377 | GGAGGUGATGGCGAGGAAGCU | 651 | 190-210 | AGCUUCCUCGCCATCACCUCCGU | 849 | 188-210 |
| AD-1557396 | AAGGCCUGTGAGGACUCCAAU | 652 | 229-249 | ATUGGAGUCCUCACAGGCCUUGA | 850 | 227-249 |
| AD-1557398 | GGCCUGUGAGGACUCCAAGAU | 653 | 231-251 | ATCUUGGAGUCCUCACAGGCCUU | 851 | 229-251 |
| AD-1557399 | GCCUGUGAGGACUCCAAGAGAU | 20 | 232-252 | ACUCUUGGAGUCCUCACAGGCCU | 852 | 230-252 |
| AD-1557400 | CCUGUGAGGACUCCAAGAGAU | 654 | 233-253 | ATCUCUGGAGTCCUCACAGGCC | 853 | 231-253 |
| AD-1557401 | CUGUGAGGACTCCAAGAGAAU | 655 | 234-254 | ATUCUCUGGAGUCCUCACAGGC | 854 | 232-254 |
| AD-1557437 | CUACUCUGGUAUUUCCUAGGU | 25 | 328-348 | ACCUAGGAAAUACCAGAGUAGCA | 151 | 326-348 |
| AD-1557440 | CUCUGGUATUTCCUAGGGUAU | 656 | 331-351 | ATACCCTAGGAAATACCAGAGUA | 855 | 329-351 |
| AD-1557441 | UCUGGUAUUCCUAGGGUACU | 657 | 332-352 | AGUACCCUAGGAAAUACCAGAGU | 155 | 330-352 |
| AD-1557442 | CUGGUAUUUCCUAGGGUACAU | 658 | 333-353 | ATGUACCCUAGGAAAUACCAGAG | 856 | 331-353 |
| AD-1557443 | UGGUAUUUCCUAGGGUACAAU | 659 | 334-354 | ATUGUACCCUAGGAAAUACCAGA | 857 | 332-354 |
| AD-1557444 | GGUAUUUCCUAGGGUACAAGU | 660 | 335-355 | ACUUGUACCCUAGGAAAUACCAG | 858 | 333-355 |
| AD-1557445 | GUAUUUCCUAGGGUACAAGGU | 661 | 336-356 | ACCUUGUACCCUAGGAAAUACCA | 859 | 334-356 |
| AD-1557452 | CUAGGGUACAAGGCGGAGGUU | 662 | 343-363 | AACCUCCGCCUTGUACCCUAGGA | 860 | 341-363 |
| AD-1557473 | AUGGUCAGCCAGGUGUACUCU | 663 | 364-384 | AGAGUACACCUGGCUGACCAUCA | 861 | 362-384 |
| AD-1557475 | GGUCAGCCAGGUGUACUCAGU | 31 | 366-386 | ACUGAGUACACCUGGCUGACCAU | 157 | 364-386 |
| AD-1557476 | GUCAGCCAGGTGUACUCAGGU | 664 | 367-387 | ACCUGAGUACACCTGGCUGACCA | 862 | 365-387 |
| AD-1557477 | UCAGCCAGGUGUACUCAGGCU | 665 | 368-388 | AGCCUGAGUACACCUGGCUGACC | 863 | 366-388 |
| AD-1557478 | CAGCCAGGTGTACUCAGGCAU | 666 | 369-389 | ATGCCUGAGUACACCUGGCUGAC | 864 | 367-389 |
| AD-1557479 | AGCCAGGUGUACUCAGGCAGU | 32 | 370-390 | ACUGCCUGAGUACACCUGGCUGA | 158 | 368-390 |
| AD-1557509 | CUCAAUCGCCACUUCUCCCAU | 667 | 400-420 | ATGGGAGAAGUGGCGAUUGAGUA | 865 | 398-420 |
| AD-1557515 | CGCCACUUCUCCCAGGAUCUU | 668 | 406-426 | AAGAUCCUGGGGAGAAGUGGCGAU | 866 | 404-426 |
| AD-1557516 | GCCACUUCTCCCAGGAUCUUU | 669 | 407-427 | AAAGAUCCUGGGAGAAGUGGCGA | 159 | 405-427 |
| AD-1557518 | CACUUCUCCCAGGAUCUUACU | 670 | 409-429 | AGUAAGAUCCUGGGAGAAGUGGC | 867 | 407-429 |
| AD-1557522 | UCUCCCAGGATCUUACCCGCU | 671 | 413-433 | AGCGGGTAAGAUCCUGGGAGAAG | 868 | 411-433 |
| AD-1557523 | CUCCCAGGAUCUUACCCGCCU | 672 | 414-434 | AGGCGGGUAAGAUCCUGGGAGAA | 869 | 412-434 |
| AD-1557524 | UCCCAGGATCTUACCCGCCGU | 673 | 415-435 | ACGGCGGGUAAGAUCCUGGGAGA | 870 | 413-435 |
| AD-1557550 | UAGUGCCUUCCGCAGUGAAAU | 674 | 441-461 | ATUCACUGCGGAAGGCACUAGA | 871 | 439-461 |
| AD-1557554 | GCCUUCCGCAGUGAAACCGCU | 36 | 445-465 | AGCGGUTCACTGCGGAAGGCAC | 162 | 443-465 |
| AD-1557555 | CCUUCCGCAGTGAAACCGCCU | 675 | 446-466 | AGGCGGTUCACUGCGGAAGGCA | 872 | 444-466 |
| AD-1557556 | CUUCCGCAGUGAAACCGCCAU | 676 | 447-467 | ATGGCGGUUUCACTGCGGAAGGC | 873 | 445-467 |
| AD-1557559 | CCGCAGUGAAACCGCCAAAGU | 677 | 450-470 | ACUUUGGCGGUUCACUGCGGAA | 874 | 448-470 |
| AD-1557560 | CGCAGUGAAACCGCCAAAGCU | 678 | 451-471 | AGCUUUGGCGGTUCACUGCGGA | 875 | 449-471 |
| AD-1557561 | GCAGUGAAACCGCCAAAGCCU | 679 | 452-472 | AGGCUUTGGCGGUUCACUGCGG | 876 | 450-472 |
| AD-1557562 | CAGUGAAACCGCCAAAGCCCU | 680 | 453-473 | AGGGCUUGGCGGUUCACUGCG | 877 | 451-473 |
| AD-1557563 | AGUGAAACCGCCAAAGCCCAU | 681 | 454-474 | ATGGGCUUUGGCGGUUUCACUGC | 878 | 452-474 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1557571 | CGCCAAAGCCCAGAAGAUGCU | 682 | 462-482 | AGCAUCUUCUGGGCUUUGGCGGU | 879 | 460-482 |
| AD-1557572 | GCCAAAGCCCAGAAGAUGCUU | 683 | 463-483 | AAGCAUCUUCUGGGCUUUGGCGG | 880 | 461-483 |
| AD-1557577 | AGCCCAGAAGAUGCUCAAGGU | 684 | 468-488 | ACCUUGAGCAUCUUCUGGGCUUU | 881 | 466-488 |
| AD-1557606 | CAGCACCCGCCUGGGAACUUU | 685 | 498-518 | AAAGUUCCCAGGCGGGUGCUGGU | 882 | 496-518 |
| AD-1557607 | AGCACCCGCCUGGGAACUUAU | 686 | 499-519 | AUAAGUUCCCAGGCGGGUGCUGG | 883 | 497-519 |
| AD-1557629 | ACAACUCCAGCUCCGUCUAUU | 687 | 521-541 | AAUAGACGGAGCUGGAGUUGUAG | 884 | 519-541 |
| AD-1557630 | CAACUCCAGCUCCGUCUAUUU | 688 | 522-542 | AAAUAGACGGAGCUGGAGUUGUA | 885 | 520-542 |
| AD-1557639 | UCACCUGCUUCUUCUGGUUCU | 689 | 560-580 | AGAACCAGAAGAAGCAGGUGAGG | 166 | 558-580 |
| AD-1557640 | CACCUGCUUCUUCUGGUUCAU | 690 | 561-581 | AUGAACCAGAAGAAGCAGGUGAG | 886 | 559-581 |
| AD-1557642 | CCUGCUUCUUCUGGUUCAUUU | 691 | 563-583 | AAAUGAACCAGAAGAAGCAGGUG | 168 | 561-583 |
| AD-1557643 | CUGCUUCUUCUGGUUCAUUCU | 692 | 564-584 | AGAAUGAACCAGAAGAAGCAGGU | 887 | 562-584 |
| AD-1557644 | UGCUUCUUCUGGUUCAUUCUU | 43 | 565-585 | AAGAAUGAACCAGAAGAAGCAGG | 169 | 563-585 |
| AD-1557646 | CUUCUUCUGGUUCAUUCUCCU | 693 | 567-587 | AGGAGAAUGAACCAGAAGAAGCA | 171 | 565-587 |
| AD-1557647 | UUCUUCUGGUUCAUUCUCCAU | 694 | 568-588 | AUGGAGAAUGAACCAGAAGAAGC | 172 | 566-588 |
| AD-1557648 | UCUUCUGGUUCAUUCUCCAAU | 695 | 569-589 | AUUGGAGAAUGAACCAGAAGAAG | 888 | 567-589 |
| AD-1557649 | CUUCUGGUUCAUUCUCCAAAU | 696 | 570-590 | AUUUGGAGAAUGAACCAGAAGAA | 889 | 568-590 |
| AD-1557650 | UUCUGGUUCAUUCUCCAAAUU | 697 | 571-591 | AAUUUGGAGAAUGAACCAGAAGA | 890 | 569-591 |
| AD-1557651 | UCUGGUUCAUUCUCCAAAUCU | 698 | 572-592 | AGAUUUGGAGAAUGAACCAGAAG | 891 | 570-592 |
| AD-1557652 | CUGGUUCAUCUCCAAAUCCU | 699 | 573-593 | AGGAUUUGGAGAAUGAACCAGAA | 892 | 571-593 |
| AD-1557682 | GUGGAGGAGCUGCUGUCCACU | 700 | 643-663 | AGUGGACAGCAGCUCCUCCACCA | 893 | 641-663 |
| AD-1557685 | GAGGAGCUGCUGUCCACAGUU | 701 | 646-666 | AACUGUGGACAGCAGCUCCUCCA | 894 | 644-666 |
| AD-1557689 | AGCUGCUGTCCACAGUCAACU | 702 | 650-670 | AGUUGACUGUGGACAGCAGCUCC | 895 | 648-670 |
| AD-1557690 | GCUGCUGUCCACAGUCAACAU | 703 | 651-671 | AUGUUGACUGUGGACAGCAGCUC | 896 | 649-671 |
| AD-1557693 | GCUGUCCACAGUCAACAGCUU | 704 | 654-674 | AAGCUGUUGACUGUGGACAGCAG | 897 | 652-674 |
| AD-1557694 | CUGUCCACAGTCAACAGCUCU | 705 | 655-675 | AGAGCUGUUGACUGUGGACAGCA | 898 | 653-675 |
| AD-1557695 | UGUCCACAGUCAACAGCUCGU | 706 | 656-676 | ACGAGCUGUUGACUGUGGACAGC | 899 | 654-676 |
| AD-1557708 | ACAGGGCCGAGUACGAAGUGU | 48 | 689-709 | ACACUUCGUACUCGGCCCUGUAG | 900 | 687-709 |
| AD-1557711 | GGGCCGAGTACGAAGUGGACU | 707 | 692-712 | AGUCCACUUCGUACUCGGCCCUG | 901 | 690-712 |
| AD-1557712 | GGCCGAGUACGAAGUGGACCU | 708 | 693-713 | AGGUCCACUUCGUACUCGGCCCU | 902 | 691-713 |
| AD-1557726 | AUCCUGGAAGCCAGUGUGAAU | 709 | 727-747 | AUCACACUGGCUUCCAGGAUCA | 903 | 725-747 |
| AD-1557727 | UCCUGGAAGCCAGUGUGAAAU | 710 | 728-748 | AUUCACACUGGCUCCAGGAUC | 904 | 726-748 |
| AD-1557728 | CCUGGAAGCCAGUGUGAAAGU | 711 | 729-749 | ACUUUCACACUGGCUUCCAGGAU | 905 | 727-749 |
| AD-1557729 | CUGGAAGCCAGUGUGAAAGAU | 712 | 730-750 | AUCUUUCACACTGGCUUCCAGGA | 906 | 728-750 |
| AD-1557730 | UGGAAGCCAGTGUGAAAGACU | 713 | 731-751 | AGUCUUUCACACUGGCUUCCAGG | 907 | 729-751 |
| AD-1557731 | GGAAGCCAGUGUGAAAGACAU | 714 | 732-752 | AUGUCUUUCACACTGGCUUCCAG | 908 | 730-752 |
| AD-1557732 | GAAGCCAGTGTGAAAGACAUU | 715 | 733-753 | AAUGUCUUUCACACUGGCUUCCA | 909 | 731-753 |
| AD-1557733 | AAGCCAGUGUGAAAGACAUAU | 716 | 734-754 | AUAUGUCUUUCACACUGGCUUCC | 910 | 732-754 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
| --- | --- | --- | --- | --- | --- | --- |
| AD-1557734 | AGCCAGUGUGAAAGACAUAGU | 717 | 735-755 | ACUAUGUCUUUCACACUGGCUUC | 911 | 733-755 |
| AD-1557735 | GCCAGUGUGAAAGACAUAGCU | 718 | 736-756 | AGCUAUGUCUUUCACACUGGCUU | 912 | 734-756 |
| AD-1557736 | CCAGUGUGAAAGACAUAGCUU | 50 | 737-757 | AAGCUAUGUCUUUCACACUGGCU | 913 | 735-757 |
| AD-1557738 | AGUGUGAAAGACAUAGCUGCU | 719 | 739-759 | AGCAGCUAUGUCUUUCACACUGG | 914 | 737-759 |
| AD-1557739 | GUGUGAAAGACAUAGCUGCAU | 720 | 740-760 | AUGCAGCUAUGUCUUUCACACUG | 915 | 738-760 |
| AD-1557740 | UGUGAAAGACAUAGCUGCAUU | 721 | 741-761 | AAUGCAGCUAUGUCUUUCACACU | 916 | 739-761 |
| AD-1557741 | GUGAAAGACAUAGCUGCAUUU | 722 | 742-762 | AAAUGCAGCUAUGUCUUUCACAC | 917 | 740-762 |
| AD-1557758 | AUUGAAUUCCACGCUGGGUUU | 52 | 759-779 | AAACCCAGCGUGGAAUUCAAUGC | 178 | 757-779 |
| AD-1557762 | AAUUCCACGCUGGGUUGUUAU | 723 | 763-783 | AUAACAACCCAGCGUGGAAUUCA | 181 | 761-783 |
| AD-1557767 | CACGCUGGGUUGUUACCGCUU | 724 | 768-788 | AAGCGGUAACAACCCAGCGUGGA | 184 | 766-788 |
| AD-1557768 | ACGCUGGGUUGUUACCGCUAU | 725 | 769-789 | AUAGCGGUAACAACCCAGCGUGG | 918 | 767-789 |
| AD-1557769 | CGCUGGGUUGUUACCGCUACU | 726 | 770-790 | AGUAGCGGUAACAACCCAGCGUG | 919 | 768-790 |
| AD-1557770 | GCUGGGUUGUUACCGCUACAU | 727 | 771-791 | AUGUAGCGGUAACAACCCAGCGU | 920 | 769-791 |
| AD-1557771 | CUGGGUUGUUACCGCUACAGU | 728 | 772-792 | ACUGUAGCGGUAACAACCCAGCG | 921 | 770-792 |
| AD-1557772 | UGGGUUGUUACCGCUACAGCU | 729 | 773-793 | AGCUGUAGCGGUAACAACCCAGC | 922 | 771-793 |
| AD-1557773 | GGGUUGUUACCGCUACAGCUU | 730 | 774-794 | AAGCUGUAGCGGUAACAACCCAG | 923 | 772-794 |
| AD-1557836 | CAAACUCCGGCUGGAGUGGAU | 731 | 888-908 | AUCCACUCCAGCCGGAGUUUGAG | 924 | 886-908 |
| AD-1557866 | GGGACCGACUGGCCAUGUAUU | 60 | 923-943 | AAUACAUGGCCAGUCGGUCCCGG | 925 | 921-943 |
| AD-1557871 | CGACUGGCCAUGUAUGACGUU | 732 | 928-948 | AACGUCAUACAUGGCCAGUCGGU | 926 | 926-948 |
| AD-1557881 | CUGGAGAAGAGGCUCAUCACU | 733 | 958-978 | AGUGAUGAGCCUCUUCUCCAGGG | 927 | 956-978 |
| AD-1557882 | UGGAGAAGAGGCUCAUCACCU | 734 | 959-979 | AGGUGAUGAGCCUCUUCUCCAGG | 928 | 957-979 |
| AD-1557883 | GGAGAAGAGGCUCAUCACCUU | 735 | 960-980 | AAGGUGAUGAGCCUCUUCUCCAG | 929 | 958-980 |
| AD-1557884 | GAGAAGAGGCUCAUCACCUCU | 736 | 961-981 | AGAGGUGAUGAGCCUCUUCUCCA | 930 | 959-981 |
| AD-1557886 | GAAGAGGCUCAUCACCUCGGU | 737 | 963-983 | ACCGAGGUGAUGAGCCUCUUCUC | 931 | 961-983 |
| AD-1557890 | AGGCUCAUCACCUCGGUGUAU | 67 | 967-987 | AUACACCGAGGUGAUGAGCCUCU | 193 | 965-987 |
| AD-1557944 | GAAGAAGGGCCUGCACAGCUU | 738 | 1053-1073 | AAGCUGUGCAGGCCCUUCUUCCA | 932 | 1051-1073 |
| AD-1557945 | AAGAAGGGCCUGCACAGCUAU | 739 | 1054-1074 | AUAGCUGUGCAGGCCCUUCUUCC | 933 | 1052-1074 |
| AD-1557948 | AAGGGCCUGCACAGCUACAUU | 740 | 1057-1077 | AAUGUAGCUGUGCAGGCCCUUCU | 934 | 1055-1077 |
| AD-1557949 | AGGGCCUGCACAGCUACUACU | 741 | 1058-1078 | AGUAGUAGCUGUGCAGGCCCUUC | 935 | 1056-1078 |
| AD-1557953 | CCUGCACAGCUACUACGACCU | 742 | 1062-1082 | AGGUCGUAGUAGCUGUGCAGGCC | 936 | 1060-1082 |
| AD-1558059 | CCUCUCUGGACUACGGCUUGU | 70 | 1235-1255 | ACAAGCCGUAGUCCAGAGAGGGC | 196 | 1233-1255 |
| AD-1558061 | UCUCUGGACUACGGCUUGGCU | 71 | 1237-1257 | AGCCAAGCCGUAGUCCAGAGAGG | 937 | 1235-1257 |
| AD-1558065 | UGGACUACGGCUUGGCCCUCU | 743 | 1241-1261 | AGAGGGCCAAGCCGUAGUCCAGA | 938 | 1239-1261 |
| AD-1558066 | GGACUACGGCUGGGCCCUCUU | 744 | 1242-1262 | AAGAGGGCCAAGCCGUAGUCCAG | 939 | 1240-1262 |
| AD-1558105 | GAGGAGGCAGAAGUAUGAUUU | 76 | 1281-1301 | AAAUCAUACUUCUGCCUCCUCAG | 202 | 1279-1301 |
| AD-1558106 | AGGAGGCAGAAGUAUGAUUUU | 745 | 1282-1302 | AAAAUCAUACUUCUGCCUCCUCA | 940 | 1280-1302 |
| AD-1558113 | AGAAGUAUGAUUGCCGUGCU | 746 | 1289-1309 | AGCACGGCAAAUCAUACUUCUGC | 209 | 1287-1309 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1558114 | GAAGUAUGAUUGCCGUGCAU | 747 | 1290-1310 | ATGCACGGCAAAUCAUACUUCUG | 210 | 1288-1310 |
| AD-1558115 | AAGUAUGAUUTGCCGUGCACU | 748 | 1291-1311 | AGUGCACGGCAAATCAUACUUCU | 941 | 1289-1311 |
| AD-1558116 | AGUAUGAUUGCCGUGCACCU | 749 | 1292-1312 | AGGUGCACGGCAAAUCAUACUUC | 942 | 1290-1312 |
| AD-1558117 | GUAUGAUUGCCGUGCACCCU | 750 | 1293-1313 | AGGGUGCACGGCAAAUCAUACUU | 943 | 1291-1313 |
| AD-1558136 | GGCCAGUGGACGAUCCAGAAU | 751 | 1315-1335 | AUUCUGGAUCGUCCACUGGCCCU | 944 | 1313-1335 |
| AD-1558137 | GCCAGUGGACGAUCCAGAACU | 752 | 1316-1336 | AGUUCUGGAUCGUCCACUGGCCC | 945 | 1314-1336 |
| AD-1558138 | CCAGUGGACGAUCCAGAACAU | 753 | 1317-1337 | ATGUUCUGGAUCGUCCACUGGCC | 946 | 1315-1337 |
| AD-1558139 | CAGUGGACGATCCAGAACAGU | 754 | 1318-1338 | ACUGUUCUGGAUCGUCCACUGGC | 947 | 1316-1338 |
| AD-1558142 | UGGACGAUCCAGAACAGGAGU | 755 | 1321-1341 | ACUCCUGUUCUGGAUCGUCCACU | 948 | 1319-1341 |
| AD-1558150 | CCAGAACAGGAGGCUGUGUGU | 87 | 1329-1349 | ACACACAGCCUCCUGUUCUGGAU | 949 | 1327-1349 |
| AD-1558152 | AGAACAGGAGGCUGUGUGGCU | 88 | 1331-1351 | AGCCACACAGCCUCCUGUUCUGG | 214 | 1329-1351 |
| AD-1558211 | ACUUCACCTCCCAGAUCUCCU | 756 | 1415-1435 | AGGAGAUCUGGGAGGUGAAGUUG | 950 | 1413-1435 |
| AD-1558215 | CACCUCCCAGAUCUCCCUCAU | 757 | 1419-1439 | ATGAGGGAGAUCUGGGAGGUGAA | 951 | 1417-1439 |
| AD-1558230 | UGUGCGGGTGCACUAUGGCUU | 758 | 1449-1469 | AAGCCATAGUGCACCCGCACACC | 215 | 1447-1469 |
| AD-1558231 | GUGCGGGUGCACUAUGGCUUU | 90 | 1450-1470 | AAAGCCAUAGUGCACCCGCACAC | 216 | 1448-1470 |
| AD-1558232 | UGCGGGUGCACUAUGGCUUGU | 759 | 1451-1471 | ACAAGCCAUAGTGCACCCGCACA | 952 | 1449-1471 |
| AD-1558233 | GCGGGUGCACTAUGGCUUGUU | 760 | 1452-1472 | AACAAGCCAUAGUGCACCCGCAC | 217 | 1450-1472 |
| AD-1558234 | CGGGUGCACUAUGGCUUGUAU | 761 | 1453-1473 | ATACAAGCCAUAGUGCACCCGCA | 953 | 1451-1473 |
| AD-1558235 | GGGUGCACTATGGCUUGUACU | 762 | 1454-1474 | AGUACAAGCCAUAGUGCACCCGC | 218 | 1452-1474 |
| AD-1558236 | GGUGCACUAUGGCUUGUACAU | 763 | 1455-1475 | ATGUACAAGCCAUAGUGCACCCG | 954 | 1453-1475 |
| AD-1558238 | UGCACUAUGGCUUGUACAACU | 764 | 1457-1477 | AGUUGUACAAGCCAUAGUGCACC | 955 | 1455-1477 |
| AD-1558239 | GCACUAUGGCUGUACAACCU | 765 | 1458-1478 | AGGUUGUACAAGCCAUAGUGCAC | 956 | 1456-1478 |
| AD-1558249 | CUGCCCUGGAGAGUUCCUCUU | 95 | 1488-1508 | AAGAGGAACUCUCCAGGGCAGGG | 221 | 1486-1508 |
| AD-1558250 | UGCCCUGGAGAGUUCCUCUGU | 766 | 1489-1509 | ACAGAGGAACUCUCCAGGGCAGG | 957 | 1487-1509 |
| AD-1558288 | AACGGCCUGGAUGAGAGAAAU | 767 | 1561-1581 | AUUUCUCUCAUCCAGGCCGUUGG | 958 | 1559-1581 |
| AD-1558289 | ACGGCCUGGATGAGAGAAACU | 768 | 1562-1582 | AGUUUCUCUCATCCAGGCCGUUG | 959 | 1560-1582 |
| AD-1558290 | CGGCCUGGAUGAGAGAAACUU | 769 | 1563-1583 | AAGUUUCUCUCAUCCAGGCCGUU | 960 | 1561-1583 |
| AD-1558292 | GCCUGGAUGAGAGAAACUGCU | 96 | 1565-1585 | AGCAGUUCUCUCAUCCAGGCCG | 222 | 1563-1585 |
| AD-1558293 | CCUGGAUGAGAGAAACUGCGU | 770 | 1566-1586 | ACGCAGUUCUCUCAUCCAGGCC | 961 | 1564-1586 |
| AD-1558301 | AGAGAAACUGCGUUUGCAGAU | 771 | 1574-1594 | AUCUGCAAACGCAGUUUCUCUCA | 962 | 1572-1594 |
| AD-1558302 | GAGAAACUGCGUUUGCAGAGU | 772 | 1575-1595 | ACUCUGCAAACGCAGUUUCUCUC | 963 | 1573-1595 |
| AD-1558308 | CUGCGUUUGCAGAGCCACAUU | 773 | 1581-1601 | AAUGUGGCUCUGCAAACGCAGUU | 964 | 1579-1601 |
| AD-1558309 | UGCGUUUGCAGAGCCACAUUU | 774 | 1582-1602 | AAAUGUGGCUCUGCAAACGCAGU | 965 | 1580-1602 |
| AD-1558310 | GCGUUUGCAGAGCCACAUUCU | 775 | 1583-1603 | AGAAUGTGGCUCUGCAAACGCAG | 966 | 1581-1603 |
| AD-1558311 | CGUUUGCAGAGCCACAUUCCU | 776 | 1584-1604 | AGGAAUGUGGCUCTGCAAACGCA | 967 | 1582-1604 |
| AD-1558316 | GCAGAGCCACAUUCCAGUGCU | 777 | 1589-1609 | AGCACUGGAAUGUGGCUCUGCAA | 968 | 1587-1609 |
| AD-1558419 | UGGGACAUTCACCUUCCAGUU | 778 | 1710-1730 | AACUGGAAGGUGAAUGUCCCACA | 228 | 1708-1730 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1558420 | GGGACAUUCACCUUCCAGUGU | 779 | 1711-1731 | ACACUGGAAGGUGAAUGUCCCAC | 969 | 1709-1731 |
| AD-1558421 | GGACAUUCACCUUCCAGUGUU | 103 | 1712-1732 | AACACUGGAAGGUGAAUGUCCCA | 229 | 1710-1732 |
| AD-1558423 | ACAUUCACCUTCCAGUGUAU | 780 | 1714-1734 | ATCACACUGGAAGGUGAAUGUCC | 231 | 1712-1734 |
| AD-1558449 | GAGCUGCGTGAAGAAGCCCAU | 781 | 1740-1760 | ATGGGCUUCUUCACGCAGCUCCG | 970 | 1738-1760 |
| AD-1558450 | AGCUGCGUGAAGAAGCCCAAU | 782 | 1741-1761 | ATUGGGCUUCUUCACGCAGCUCC | 971 | 1739-1761 |
| AD-1558451 | GCUGCGUGAAGAAGCCCAACU | 783 | 1742-1762 | AGUUGGGCUUCUUCACGCAGCUC | 972 | 1740-1762 |
| AD-1558452 | CUGCGUGAAGAAGCCCAACCU | 784 | 1743-1763 | AGGUUGGGCUUCUUCACGCAGCU | 973 | 1741-1763 |
| AD-1558453 | UGCGUGAAGAAGCCCAACCCU | 785 | 1744-1764 | AGGGUUGGGCUUCUUCACGCAGC | 974 | 1742-1764 |
| AD-1558508 | AGCACUGUGACUGUGGCCUCU | 786 | 1808-1828 | AGAGGCCACAGTCACAGUGCUCC | 975 | 1806-1828 |
| AD-1558546 | CUCCGAGGGUGAGUGGCCAUU | 787 | 1866-1886 | AAUGGCCACUCACCCUCGGAGGA | 976 | 1864-1886 |
| AD-1558576 | AUCGCUGACCGCUGGGUGAUU | 107 | 1936-1956 | AAUCACCCAGCGGTCAGCGAUGA | 977 | 1934-1956 |
| AD-1558577 | UCGCUGACCGCUGGGUGAUAU | 788 | 1937-1957 | ATAUCACCCAGCGGUCAGCGAUG | 978 | 1935-1957 |
| AD-1558578 | CGCUGACCGCUGGGUGAUAAU | 789 | 1938-1958 | ATUAUCACCCAGCGGUCAGCGAU | 979 | 1936-1958 |
| AD-1558579 | GCUGACCGCUGGGUGAUAACU | 790 | 1939-1959 | AGUUAUCACCCAGCGGUCAGCGA | 980 | 1937-1959 |
| AD-1558586 | GCUGGGUGAUAACAGCUGCCU | 791 | 1946-1966 | AGGCAGCUGUUAUCACCCAGCGG | 981 | 1944-1966 |
| AD-1558609 | UGCUUCCAGGAGGACAGCAUU | 792 | 1969-1989 | AAUGCUGUCCUCCUGGAAGCAGU | 982 | 1967-1989 |
| AD-1558610 | GCUUCCAGGAGGACAGCAUGU | 793 | 1970-1990 | ACAUGCUGUCCUCCUGGAAGCAG | 983 | 1968-1990 |
| AD-1558611 | CUUCCAGGAGGACAGCAUGGU | 794 | 1971-1991 | ACCAUGCUGUCCUCCUGGAAGCA | 984 | 1969-1991 |
| AD-1558650 | CGUGUUCCTGGGCAAGGUGUU | 795 | 2010-2030 | AACACCUUGCCCAGGAACACGGU | 235 | 2008-2030 |
| AD-1558657 | CUGGGCAAGGUGUGGCAGAAU | 796 | 2017-2037 | ATUCUGCCACACCUGCCCAGGA | 985 | 2015-2037 |
| AD-1558658 | UGGGCAAGGUGUGGCAGAACU | 797 | 2018-2038 | AGUUCUGCCACACCUUGCCCAGG | 986 | 2016-2038 |
| AD-1558659 | GGGCAAGGUGUGGCAGAACUU | 798 | 2019-2039 | AAGUUCUGCCACACCUUGCCCAG | 987 | 2017-2039 |
| AD-1558660 | GGCAAGGUGUGGCAGAACUCU | 799 | 2020-2040 | AGAGUUCUGCCACACCUUGCCCA | 988 | 2018-2040 |
| AD-1558661 | GCAAGGUGTGGCAGAACUCGU | 800 | 2021-2041 | ACGAGUUCUGCCACACCUUGCCC | 237 | 2019-2041 |
| AD-1558662 | CAAGGUGUGGCAGAACUCGCU | 801 | 2022-2042 | AGCGAGUUCUGCCACACCUUGCC | 989 | 2020-2042 |
| AD-1558683 | UGGCCUGGAGAGGUGUCCUUU | 802 | 2044-2064 | AAAGGACACCUCUCCAGGCCAGC | 990 | 2042-2064 |
| AD-1558684 | GGCCUGGAGAGGUGUCCUUCU | 803 | 2045-2065 | AGAAGGACACCUCUCCAGGCCAG | 991 | 2043-2065 |
| AD-1558685 | GCCUGGAGAGGUGUCCUUCAU | 804 | 2046-2066 | ATGAAGGACACCUCUCCAGGCCA | 992 | 2044-2066 |
| AD-1558686 | CCUGGAGAGGTGUCCUUCAAU | 805 | 2047-2067 | ATUGAAGGACACCTCUCCAGGCC | 993 | 2045-2067 |
| AD-1558687 | CUGGAGAGGUGUCCUUCAAGU | 113 | 2048-2068 | ACUUGAAGGACACCUCUCCAGGC | 239 | 2046-2068 |
| AD-1558691 | AGAGGUGUCCUUCAAGGUGAU | 806 | 2052-2072 | ATCACCUUGAAGGACACCUCUCC | 242 | 2050-2072 |
| AD-1558833 | UGUGCAGUGAUCCCACAGGU | 807 | 2289-2309 | ACCUGUGGGAUCAACUGCACAUC | 994 | 2287-2309 |
| AD-1558835 | UGCAGUUGAUCCCACAGGACU | 808 | 2291-2311 | AGUCCUGUGGGAUCAACUGCACA | 995 | 2289-2311 |
| AD-1558843 | AUCCCACAGGACCUGUGCAGU | 117 | 2299-2319 | ACUGCACAGGUCCTGUGGGAUCA | 996 | 2297-2319 |
| AD-1558845 | CCCACAGGACCUGUGCAGCGU | 809 | 2301-2321 | ACGCUGCACAGGUCCUGUGGGAU | 997 | 2299-2321 |
| AD-1558846 | CCACAGGACCTGUGCAGCGAU | 810 | 2302-2322 | ATCGCUGCACAGGTCCUGUGGGA | 998 | 2300-2322 |
| AD-1558878 | CCAGGUGACGCCACGCAUGCU | 811 | 2334-2354 | AGCAUGCGUGGCGUCACCUGGUA | 999 | 2332-2354 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
|---|---|---|---|---|---|---|
| AD-1558882 | GUGACGCCACGCAUGCUGUGU | 812 | 2338-2358 | ACACAGCAUGCGUGGCGUCACCU | 1000 | 2336-2358 |
| AD-1558883 | UGACGCCACGCAUGCUGUGUU | 118 | 2339-2359 | AACACAGCAUGCGTGGCGUCACC | 1001 | 2337-2359 |
| AD-1558885 | ACGCCACGCATGCUGUGUGCU | 813 | 2341-2361 | AGCACACAGCATGCGUGGCGUCA | 1002 | 2339-2361 |
| AD-1558905 | GGCUACCGCAAGGGCAAGAAU | 814 | 2362-2382 | AUUCUUGCCCUGCGGUAGCCGG | 1003 | 2360-2382 |
| AD-1558906 | GCUACCGCAAGGGCAAGAAGU | 120 | 2363-2383 | ACUUCUGCCCUGCGGUAGCCG | 246 | 2361-2383 |
| AD-1558907 | CUACCGCAAGGGCAAGAAGGU | 121 | 2364-2384 | ACCUUCUGCCCUGCGGUAGCC | 1004 | 2362-2384 |
| AD-1558961 | GUGCAAGGCACUCAGUGGCCU | 815 | 2418-2438 | AGGCCACUGAGUGCCUUGCACAC | 1005 | 2416-2438 |
| AD-1558992 | CUAACUACUUCGGCGUCUACU | 816 | 2486-2506 | AGUAGACGCCGAAGUAGUUAGGC | 1006 | 2484-2506 |
| AD-1558995 | ACUACUUCGGCGUCUACACCU | 817 | 2489-2509 | AGGUGUAGACGCCGAAGUAGUUA | 1007 | 2487-2509 |
| AD-1558996 | CUACUUCGGCGUCUACACCCU | 818 | 2490-2510 | AGGGUGUAGACGCCGAAGUAGUU | 1008 | 2488-2510 |
| AD-1559004 | GCGUCUACACCCGCAUCACAU | 819 | 2498-2518 | AUGUGAUGCGGGUGUAGACGCCG | 1009 | 2496-2518 |
| AD-1559005 | CGUCUACACCCGCAUCACAGU | 820 | 2499-2519 | ACUGUGAUGCGGGUGUAGACGCC | 1010 | 2497-2519 |
| AD-1559008 | CUACACCCGCAUCACAGGUGU | 124 | 2502-2522 | ACACCUGUGAUGCGGGUGUAGAC | 250 | 2500-2522 |
| AD-1559012 | ACCCGCAUCACAGGUGUGAUU | 821 | 2506-2526 | AAUCACACCUGTGAUGCGGGUGU | 1011 | 2504-2526 |
| AD-1559013 | CCCGCAUCACAGGUGUGAUCU | 822 | 2507-2527 | AGAUCACACCUGUGAUGCGGGUG | 1012 | 2505-2527 |
| AD-1559036 | UGGAUCCAGCAAGUGGUGACU | 823 | 2530-2550 | AGUCACCACUUGCUGGAUCCAGC | 1013 | 2528-2550 |
| AD-1559038 | GAUCCAGCAAGUGGUGACCUU | 824 | 2532-2552 | AAGGUCACCACUUGCUGGAUCCA | 1014 | 2530-2552 |
| AD-1559039 | AUCCAGCAAGTGGUGACCUGU | 825 | 2533-2553 | ACAGGUCACCACUUGCUGGAUCC | 1015 | 2531-2553 |
| AD-1559041 | CCAGCAAGUGGUGACCUGAGU | 826 | 2535-2555 | ACUCAGGUCACCACUUGCUGGAU | 1016 | 2533-2555 |
| AD-1559042 | CAGCAAGUGGUGACCUGAGGU | 827 | 2536-2556 | ACCUCAGGUCACCACUUGCUGGA | 1017 | 2534-2556 |
| AD-1559044 | GCAAGUGGUGACCUGAGGAAU | 828 | 2538-2558 | AUCCUCAGGUCACCACUUGCUG | 1018 | 2536-2558 |
| AD-1559105 | UGGUGGCAGGAGGUGGCAUCU | 829 | 2667-2687 | AGAUGCCACCUCCUGCCACCACA | 1019 | 2665-2687 |
| AD-1559106 | GGUGGCAGGAGGUGGCAUCUU | 830 | 2668-2688 | AAGAUGCCACCUCCUGCCACCAC | 1020 | 2666-2688 |
| AD-1559107 | GUGGCAGGAGGUGGCAUCUUU | 831 | 2669-2689 | AAAGAUGCCACCUCCUGCCACCA | 1021 | 2667-2689 |
| AD-1559109 | GGCAGGAGGUGGCAUCUUGUU | 127 | 2671-2691 | AACAAGAUGCCACCUCCUGCCAC | 253 | 2669-2691 |
| AD-1559133 | UCCCUGAUGUCUGCUCCAGUU | 832 | 2695-2715 | AACUGGAGCAGACAUCAGGGACG | 1022 | 2693-2715 |
| AD-1559136 | CUGAUGUCTGCUCCAGUGAUU | 833 | 2698-2718 | AAUCACUGGAGCAGACAUCAGGG | 1023 | 2696-2718 |
| AD-1559147 | UCCAGUGAUGGCAGGAGGAUU | 834 | 2709-2729 | AAUCCUCCUGCCAUCACUGGAGC | 1024 | 2707-2729 |
| AD-1559233 | GGCUCAGCAGCAAGAAUGCUU | 132 | 2853-2873 | AAGCAUUCUUGCUGCUGAGCCAC | 258 | 2851-2873 |
| AD-1559318 | CUAACUUGGGAUCUGGGAAUU | 835 | 2978-2998 | AAUUCCCAGAUCCCAAGUUAGAC | 1025 | 2976-2998 |
| AD-1559323 | UUGGGAUCUGGGAAUGGAAGU | 836 | 2983-3003 | ACUUCCAUUCCCAGAUCCCAAGU | 264 | 2981-3003 |
| AD-1559431 | GUGAGCUCAGCUGCCCUUUGU | 837 | 3157-3177 | ACAAAGGGCAGCUGAGCUCACCU | 1026 | 3155-3177 |
| AD-1559436 | CUCAGCUGCCCUUUGGAAUAU | 838 | 3162-3182 | AUAUUCCAAAGGGCAGCUGAGCU | 1027 | 3160-3182 |
| AD-1559437 | UCAGCUGCCCUUUGGAAUAAU | 839 | 3163-3183 | AUUAUUCCAAAGGGCAGCUGAGC | 1028 | 3161-3183 |
| AD-1559438 | CAGCUGCCCUUGGAAUAAAU | 840 | 3164-3184 | AUUUAUCCAAAGGGCAGCUGAG | 1029 | 3162-3184 |
| AD-1559441 | CUGCCCUUGAAUAAAGCUU | 841 | 3167-3187 | AAGCUUUAUUCCAAAGGGCAGCU | 1030 | 3165-3187 |
| AD-1559443 | GCCCUUUGGAAUAAAGCUGCU | 842 | 3169-3189 | AGCAGCUUUAUUCCAAAGGGCAG | 1031 | 3167-3189 |

TABLE 4-continued

Unmodified Sense and Antisense Strand Sequences of TMPRSS6 dsRNA Agent

| Duplex Name | Sense Sequence 5' to 3' | SEQ ID NO: | Range in NM_153609.4 | Antisense Sequence 5' to 3' | SEQ ID NO: | Range in NM_153609.4 |
| --- | --- | --- | --- | --- | --- | --- |
| AD-1559444 | CCCUUUGGAAUAAAGCUGCCU | 843 | 3170-3190 | AGGCAGCUUUAUUCCAAAGGGCA | 1032 | 3168-3190 |
| AD-1559445 | CCUUUGGAAUAAAGCUGCCUU | 844 | 3171-3191 | AAGGCAGCUUUAUUCCAAAGGGC | 1033 | 3169-3191 |
| AD-1559447 | UUUGGAAUAAAGCUGCCUGAU | 845 | 3173-3193 | AUCAGGCAGCUUUAUUCCAAAGG | 1034 | 3171-3193 |
| AD-1559448 | UUGGAAUAAAGCUGCCUGAUU | 846 | 3174-3194 | AAUCAGGCAGCUUUAUUCCAAAG | 1035 | 3172-3194 |
| AD-1559449 | UGGAAUAAAGCUGCCUGAUCU | 847 | 3175-3195 | AGAUCAGGCAGCUUUAUUCCAAA | 1036 | 3173-3195 |

TABLE 5

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
| --- | --- | --- | --- | --- | --- | --- |
| AD-1557376 | csgsgaggugdAudGgcgaggaaguL96 | 1037 | asdCsuucc(Tgn)cgccdAudCaccuccgsusc | 1264 | GACGGAGGUGAUGGCGAGGAAGC | 1491 |
| AD-1557377 | gsgsaggugadTgdGcgaggaagcuL96 | 1038 | asdGscuuc(C2p)ucgcdCadTcaccuccsgsu | 1265 | ACGGAGGUGAUGGCGAGGAAGCG | 1492 |
| AD-1557396 | asasggccugdTgdAggacuccaauL96 | 1039 | asdTsugga(G2p)uccudCadCaggccuusgsa | 1266 | UCAAGGCCUGUGAGGACUCCAAG | 1493 |
| AD-1557398 | gsgsccugugdAgdGacuccaagauL96 | 1040 | asdTscuug(G2p)aguecdCudCacaggccsusu | 1267 | AAGGCCUGUGAGGACUCCAAGAG | 1494 |
| AD-1557399 | gscscugugadGgdAcuccaagagauL96 | 1041 | asdCsucuu(G2p)gagudCcdTcacaggcscsu | 1268 | AGGCCUGUGAGGACUCCAAGAGA | 524 |
| AD-1557400 | cscsugugagdGadCuccaagagauL96 | 1042 | asdTscucu(Tgn)ggagdTcdCucacaggscsc | 1269 | GGCCUGUGAGGACUCCAAGAGAA | 1495 |
| AD-1557401 | csusgugaggdAcdTccaagagaauL96 | 1043 | asdTsucuc(Tgn)uggadGudCcucacagsgsc | 1270 | GCCUGUGAGGACUCCAAGAGAAA | 1496 |
| AD-1557437 | csusacucugdGudAuuuccuagguL96 | 1044 | asdCscuag(G2p)aaaudAcdCagaguagscsa | 1271 | UGCUACUCUGGUAUUUCCUAGGG | 529 |
| AD-1557440 | csuscuggadTudTccuagggauL96 | 1045 | asdTsaccc(Tgn)aggadAadTaccagagsusa | 1272 | UACUCUGGUAUUUCCUAGGGUAC | 532 |
| AD-1557441 | uscsugguaudTudCcuagggacuL96 | 1046 | asdGsuacc(C2p)uaggdAadAuaccagasgsu | 1273 | ACUCUGGUAUUUCCUAGGGUACA | 533 |
| AD-1557442 | csusgguauudTcdCuagggacauL96 | 1047 | asdTsguac(C2p)cuagdGadAuaccagsasg | 1274 | CUCUGGUAUUUCCUAGGGUACAA | 1497 |
| AD-1557443 | usgsguauuudCcdTagggacaauL96 | 1048 | asdTsugua(C2p)ccuadGgdAaauaccasgsa | 1275 | UCUGGUAUUUCCUAGGGUACAAG | 1498 |
| AD-1557444 | gsgsuauuucdCudAgggacaaguL96 | 1049 | asdCsuugu(Agn)cccudAgdGaaauaccsasg | 1276 | CUGGUAUUUCCUAGGGUACAAGG | 1499 |
| AD-1557445 | gsusauuuccdTadGggacaagguL96 | 1050 | asdCscuug(Tgn)acccdTadGgaaauacscsc | 1277 | UGGUAUUUCCUAGGGUACAAGGC | 1500 |
| AD-1557452 | csusaggguadCadAggcggagguL96 | 1051 | asdAsccuc(C2p)gccudTgdTacccuagsgsa | 1278 | UCCUAGGGUACAAGGCGGAGGUG | 1501 |
| AD-1557473 | asusggucagdCcdAggguacucuL96 | 1052 | asdGsagua(C2p)accudGgdCugaccauscsa | 1279 | UGAUGGUCAGCCAGGUGUACUCA | 1502 |
| AD-1557475 | gsgsucagccdAgdGuguacucagL96 | 1053 | asdCsugag(Tgn)acacdCudGgcugaccsasu | 1280 | AUGGUCAGCCAGGUGUACUCAGG | 535 |
| AD-1557476 | gsuscagccadGgdTguacucagguL96 | 1054 | asdCscuga(G2p)uacadCcdTggcugacscsa | 1281 | UGGUCAGCCAGGUGUACUCAGGC | 1503 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1557477 | uscsagccagdGud GuacucaggcuL96 | 1055 | asdGsccug(Agn)gua cdAcdCuggcugascsc | 1282 | GGUCAGCCAGGUGUACUCAGGCA | 1504 |
| AD-1557478 | csasgccaggdTgd TacucaggcauL96 | 1056 | asdTsgccu(G2p)agu adCadCcuggcugsasc | 1283 | GUCAGCCAGGUGUACUCAGGCAG | 1505 |
| AD-1557479 | asgsccaggudGud AcucaggcaguL96 | 1057 | asdCsugcc(Tgn)gag udAcdAccuggcusgsa | 1284 | UCAGCCAGGUGUACUCAGGCAGU | 536 |
| AD-1557509 | csuscaaucgdCcd AcuucucccauL96 | 1058 | asdTsggga(G2p)aag udGgdCgauugagsusa | 1285 | UACUCAAUCGCCACUUCUCCCAG | 1506 |
| AD-1557515 | csgsccacuudCud CccaggaucuuL96 | 1059 | asdAsgauc(C2p)ugg gdAgdAaguggcgsasu | 1286 | AUCGCCACUUCUCCCAGGAUCUU | 1507 |
| AD-1557516 | gscscacuucdTcd CcaggaucuuuL96 | 1060 | asdAsagau(C2p)cug gdGadGaaguggcsgsa | 1287 | UCGCCACUUCUCCCAGGAUCUUA | 537 |
| AD-1557518 | csascuucucdCcd AggaucuuacuL96 | 1061 | asdGsuaag(Agn)ucc udGgdGagaagugsgsc | 1288 | GCCACUUCUCCCAGGAUCUUACC | 1508 |
| AD-1557522 | uscsucccagdGad TcuuacccgcuL96 | 1062 | asdGscggg(Tgn)aag adTcdCugggagasasg | 1289 | CUUCUCCCAGGAUCUUACCCGCC | 1509 |
| AD-1557523 | csusccaggdAud CuuacccgccuL96 | 1063 | asdGsgcgg(G2p)uaa gdAudCcugggagsasa | 1290 | UUCUCCCAGGAUCUUACCCGCCG | 1510 |
| AD-1557524 | uscsccaggadTcd TuacccgccguL96 | 1064 | asdCsggcg(G2p)gua adGadTccugggasgsa | 1291 | UCUCCCAGGAUCUUACCCGCCGG | 539 |
| AD-1557550 | usasgugccudTcd CgcagugaaauL96 | 1065 | asdTsuuca(C2p)ugc gdGadAggcacuasgsa | 1292 | UCUAGUGCCUUCCGCAGUGAAAC | 1511 |
| AD-1557554 | gscscuuccgdCad GugaaaccgcuL96 | 1066 | asdGscggu(Tgn)uca cdTgdCggaaggcsasc | 1293 | GUGCCUUCCGCAGUGAAACCGCC | 540 |
| AD-1557555 | cscsuuccgcdAgd TgaaaccgccuL96 | 1067 | asdGsgcgg(Tgn)uuc adCudGcgaaggcsa | 1294 | UGCCUUCCGCAGUGAAACCGCCA | 1512 |
| AD-1557556 | csusuccgcadGud GaaaccgccauL96 | 1068 | asdTsggcg(G2p)uuu cdAcdTgcggaagsgsc | 1295 | GCCUUCCGCAGUGAAACCGCCAA | 1513 |
| AD-1557559 | cscsgcagugdAad AccgccaaaguL96 | 1069 | asdCsuuug(G2p)cgg udTudCacugcggsasa | 1296 | UUCCGCAGUGAAACCGCCAAAGC | 1514 |
| AD-1557560 | csgscagugadAad CcgccaaagcuL96 | 1070 | asdGscuuu(G2p)gcg gdTudTcacugcgsgsa | 1297 | UCCGCAGUGAAACCGCCAAAGCC | 1515 |
| AD-1557561 | gscsagugaadAcd CgccaaagccuL96 | 1071 | asdGsgcuu(Tgn)ggc gdGudTucacugcsgsg | 1298 | CCGCAGUGAAACCGCCAAAGCCC | 1516 |
| AD-1557562 | csasgugaaadCcd GccaaagcccuL96 | 1072 | asdGsggcu(Tgn)ugg cdGgdTuucacugscsg | 1299 | CGCAGUGAAACCGCCAAAGCCCA | 1517 |
| AD-1557563 | asgsugaaacdGcd CcaaagcccauL96 | 1073 | asdTsgggc(Tgn)uug gdCgdGuuucacusgsc | 1300 | GCAGUGAAACCGCCAAAGCCCAG | 1518 |
| AD-1557571 | csgsccaaagdCcd CagaagaugcuL96 | 1074 | asdGscauc(Tgn)ucu gdGgdCuuggcgsgsu | 1301 | ACCGCCAAAGCCCAGAAGAUGCU | 1519 |
| AD-1557572 | gscscaaagcdCcd AgaagaugcuuL96 | 1075 | asdAsgcau(C2p)uuc udGgdGcuuggcsgsg | 1302 | CCGCCAAAGCCCAGAAGAUGCUC | 1520 |
| AD-1557577 | asgscccagadAgd AugcucaagguL96 | 1076 | asdCscuug(Agn)gca udCudTcgggcususu | 1303 | AAAGCCCAGAAGAUGCUCAAGGA | 1521 |
| AD-1557606 | csasgcacccdGcd CugggaacuuuL96 | 1077 | asdAsaguu(C2p)cca gdGcdGggugcugsgsu | 1304 | ACCAGCACCCGCCUGGGAACUUA | 1522 |
| AD-1557607 | asgscacccgdCcd TgggaacuuauL96 | 1078 | asdTsaagu(Tgn)ccc adGgdCggugcusgsg | 1305 | CCAGCACCCGCCUGGGAACUUAC | 1523 |
| AD-1557629 | ascsaacuccdAgd CuccgucuauuL96 | 1079 | asdAsuaga(C2p)gga gdCudGgaguugusasg | 1306 | CUACAACUCCAGCUCCGUCUAUU | 1524 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1557630 | csasacuccadGcd TccgcuauuuL96 | 1080 | asdAsauag(Agn)cgg adGcdTggaguugsusa | 1307 | UACAACUCCAGCUCCGUCUAUUC | 541 |
| AD-1557639 | uscsaccugcdTud CuucugguucaL96 | 1081 | asdGsaacc(Agn)gaa gdAadGcaggugasgsg | 1308 | CCUCACCUGCUUCUUCUGGUUCA | 544 |
| AD-1557640 | csasccugcudTcd TucugguucauL96 | 1082 | asdTsgaac(C2p)aga adGadAgcaggugsasg | 1309 | CUCACCUGCUUCUUCUGGUUCAU | 1525 |
| AD-1557642 | cscsugcuucdTud CugguucauuL96 | 1083 | asdAsauga(Agn)cca gdAadGaagcaggsusg | 1310 | CACCUGCUUCUUCUGGUUCAUUC | 546 |
| AD-1557643 | csusgcuucdTcd TgguucauucuL96 | 1084 | asdGsaaug(Agn)acc adGadAgaagcagsgsu | 1311 | ACCUGCUUCUUCUGGUUCAUUCU | 1526 |
| AD-1557644 | usgscuucuudCud GguucauucuuL96 | 1085 | asdAsgaau(G2p)aac cdAgdAagaagcasgsg | 1312 | CCUGCUUCUUCUGGUUCAUUCUC | 547 |
| AD-1557646 | csusucuucdGgd TucauucccuL96 | 1086 | asdGsgaga(Agn)uga adCcdAgaagaagscsa | 1313 | UGCUUCUUCUGGUUCAUUCUCCA | 549 |
| AD-1557647 | ususcuucugdGud TcauucccauL96 | 1087 | asdTsggag(Agn)aug adAcdCagaagaasgsc | 1314 | GCUUCUUCUGGUUCAUUCUCCAA | 550 |
| AD-1557648 | uscsuucuggdTud CauucccaauL96 | 1088 | asdTsugga(G2p)aau gdAadCcagaagasasg | 1315 | CUUCUUCUGGUUCAUUCUCCAAA | 1527 |
| AD-1557649 | csusucuggudTcd AuuccaaauL96 | 1089 | asdTsuugg(Agn)gaa udGadAccagaagsasa | 1316 | UUCUUCUGGUUCAUUCUCCAAAU | 1528 |
| AD-1557650 | ususcugguudCad TucccaaauuL96 | 1090 | asdAsuuug(G2p)aga adTgdAaccagaasgsa | 1317 | UCUUCUGGUUCAUUCUCCAAAUC | 1529 |
| AD-1557651 | uscsugguucdAud TcccaaaucuL96 | 1091 | asdGsauuu(G2p)gag adAudGaaccagasasg | 1318 | CUUCUGGUUCAUUCUCCAAAUCC | 1530 |
| AD-1557652 | csusgguucadTud CuccaaauccL96 | 1092 | asdGsgauu(Tgn)gga gdAadTgaaccagsasa | 1319 | UUCUGGUUCAUUCUCCAAAUCCC | 551 |
| AD-1557682 | gsusggaggadGcd TgcuguccacuL96 | 1093 | asdGsugga(C2p)agc adGcdTccuccacscsa | 1320 | UGGUGGAGGAGCUGCUGUCCACA | 1531 |
| AD-1557685 | gsasggagcudGcd TguccacaguuL96 | 1094 | asdAscugu(G2p)gac adGcdAgcuccucscsa | 1321 | UGGAGGAGCUGCUGUCCACAGUC | 1532 |
| AD-1557689 | asgscugcugdTcd CacagucaacuL96 | 1095 | asdGsuuga(C2p)ugu gdGadCagcagcuscsc | 1322 | GGAGCUGCUGUCCACAGUCAACA | 1533 |
| AD-1557690 | gscsugcugudCcd AcagucaacauL96 | 1096 | asdTsguug(Agn)cug udGgdAcagcagcsusc | 1323 | GAGCUGCUGUCCACAGUCAACAG | 1534 |
| AD-1557693 | gscsuguccadCad GucaacagcuuL96 | 1097 | asdAsgcug(Tgn)uga cdTgdTggacagcsasg | 1324 | CUGCUGUCCACAGUCAACAGCUC | 1535 |
| AD-1557694 | csusguccacdAgd TcaacagcucuL96 | 1098 | asdGsagcu(G2p)uug adCudGuggacagscsa | 1325 | UGCUGUCCACAGUCAACAGCUCG | 1536 |
| AD-1557695 | usgsuccacadGud CaacagcucguL96 | 1099 | asdCsgagc(Tgn)guu gdAcdTguggacasgsc | 1326 | GCUGUCCACAGUCAACAGCUCGG | 1537 |
| AD-1557708 | ascsagggccdGad GuacgaaguguL96 | 1100 | asdCsacuu(C2p)gua cdTcdGgcccugusasg | 1327 | CUACAGGGCCGAGUACGAAGUGG | 552 |
| AD-1557711 | gsgsgccgagdTad CgaaguggacuL96 | 1101 | asdGsucca(C2p)uuc gdTadCucggcccsusg | 1328 | CAGGGCCGAGUACGAAGUGGACC | 1538 |
| AD-1557712 | gsgsccgagudAcd GaaguggaccuL96 | 1102 | asdGsgucc(Agn)cuu cdGudAcucggccscsu | 1329 | AGGGCCGAGUACGAAGUGGACCC | 1539 |
| AD-1557726 | asusccuggadAgd CcagugugaauL96 | 1103 | asdTsucac(Agn)cug gdCudTccaggauscsa | 1330 | UGAUCCUGGAAGCCAGUGUGAAA | 1540 |
| AD-1557727 | uscsccuggaadGcd CagugugaaauL96 | 1104 | asdTsuuca(C2p)acu gdGcdTuccaggasusc | 1331 | GAUCCUGGAAGCCAGUGUGAAAG | 1541 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1557728 | cscsuggaagdCcdAgugugaaaguL96 | 1105 | asdCsuuuc(Agn)cacudGgdCuuccaggsasu | 1332 | AUCCUGGAAGCCAGUGUGAAAGA | 1542 |
| AD-1557729 | csusggaagcdCadGugugaaagauL96 | 1106 | asdTscuuu(C2p)acacdTgdGcuuccagsgsa | 1333 | UCCUGGAAGCCAGUGUGAAAGAC | 1543 |
| AD-1557730 | usgsgaagccdAgdTgugaaagacuL96 | 1107 | asdGsucuu(Tgn)cacadCudGgcuuccasgsg | 1334 | CCUGGAAGCCAGUGUGAAAGACA | 1544 |
| AD-1557731 | gsgsaagccadGudGugaaagacauL96 | 1108 | asdTsgucu(Tgn)ucacdAcdTggcuuccsasg | 1335 | CUGGAAGCCAGUGUGAAAGACAU | 1545 |
| AD-1557732 | gsasagccagdTgdTgaaagacauuL96 | 1109 | asdAsuguc(Tgn)uucadCadCuggcuuscsa | 1336 | UGGAAGCCAGUGUGAAAGACAUA | 1546 |
| AD-1557733 | asasgccagudGudGaaagacauauL96 | 1110 | asdTsaugu(C2p)uuucdAcdAcuggcuuscsc | 1337 | GGAAGCCAGUGUGAAAGACAUAG | 1547 |
| AD-1557734 | asgsccagugdTgdAaagacauaguL96 | 1111 | asdCsuaug(Tgn)cuuudCadCacuggcusuusc | 1338 | GAAGCCAGUGUGAAAGACAUAGC | 1548 |
| AD-1557735 | gscscagugudGadAagacauagcuL96 | 1112 | asdGscuau(G2p)ucuudTcdAcacuggcsusu | 1339 | AAGCCAGUGUGAAAGACAUAGCU | 1549 |
| AD-1557736 | cscsagugugdAadAgacauagcuuL96 | 1113 | asdAsgcua(Tgn)gucudTudCacacuggscsu | 1340 | AGCCAGUGUGAAAGACAUAGCUG | 554 |
| AD-1557738 | asgsuguguaadAgdAcauagcugcuL96 | 1114 | asdGscagc(Tgn)augudCudTcacacusgsg | 1341 | CCAGUGUGAAAGACAUAGCUGCA | 1550 |
| AD-1557739 | gsusgugaaadGadCauagcugcauL96 | 1115 | asdTsgcag(C2p)uaugdTcdTuucacacsusg | 1342 | CAGUGUGAAAGACAUAGCUGCAU | 1551 |
| AD-1557740 | usgsugaaagdAcdAuagcugcauuL96 | 1116 | asdAsugca(G2p)cuaudGudCuuucacascsu | 1343 | AGUGUGAAAGACAUAGCUGCAUU | 1552 |
| AD-1557741 | gsusgaaagadCadTagcugcauuuL96 | 1117 | asdAsaugc(Agn)gcuadTgdTcuuucacsasc | 1344 | GUGUGAAAGACAUAGCUGCAUUG | 1553 |
| AD-1557758 | asusugaauudCcdAcgcugggutuL96 | 1118 | asdAsaccc(Agn)gcgudGgdAauucaausgsc | 1345 | GCAUUGAAUUCCACGCUGGGUUG | 556 |
| AD-1557762 | asasuuccacdGcdTggguuguuauL96 | 1119 | asdTsaaca(Agn)cccadGcdGuggaauuscsa | 1346 | UGAAUUCCACGCUGGGUUGUUAC | 559 |
| AD-1557767 | csascgcuggdGudTguuaccgcuuL96 | 1120 | asdAsgcgg(Tgn)aacadAcdCcagcgusgsga | 1347 | UCCACGCUGGGUUGUUACCGCUA | 562 |
| AD-1557768 | ascsgcugggdTudGuuaccgcuauL96 | 1121 | asdTsagcg(G2p)uaacdAadCccagcgusgsg | 1348 | CCACGCUGGGUUGUUACCGCUAC | 1554 |
| AD-1557769 | csgscugggudTgdTuaccgcuacuL96 | 1122 | asdGsuagc(G2p)guaadCadAcccagcgsusg | 1349 | CACGCUGGGUUGUUACCGCUACA | 1555 |
| AD-1557770 | gscsugggutudGudTaccgcuacauL96 | 1123 | asdTsguag(C2p)gguadAcdAacccagcsgsu | 1350 | ACGCUGGGUUGUUACCGCUACAG | 1556 |
| AD-1557771 | csusgggutugdTudAccgcuacaguL96 | 1124 | asdCsugua(G2p)cggudAadCaacccagscsg | 1351 | CGCUGGGUUGUUACCGCUACAGC | 563 |
| AD-1557772 | usgsgguugudTadCcgcuacagcuL96 | 1125 | asdGscugu(Agn)gcggdTadAcaacccasgsc | 1352 | GCUGGGUUGUUACCGCUACAGCU | 1557 |
| AD-1557773 | gsgsuuguutudAcdCgcuacagcuuL96 | 1126 | asdAsgcug(Tgn)agcgdGudAacaacccsasg | 1353 | CUGGGUUGUUACCGCUACAGCUA | 1558 |
| AD-1557836 | csasaacuccdGgdCuggagugauL96 | 1127 | asdTsccac(Tgn)ccagdCcdGgaguuugsasg | 1354 | CUCAAACUCCGGCUGGAGUGGAC | 1559 |
| AD-1557866 | gsgsgaccgadCudGgccauguauuL96 | 1128 | asdAsuaca(Tgn)ggccdAgdTcgguccscsg | 1355 | CCGGGACCGACUGGCCAUGUAUG | 564 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1557871 | csgsacuggcdCadTguaugacguuL96 | 1129 | asdAscguc(Agn)uacadTgdGccagucgsgsu | 1356 | ACCGACUGGCCAUGUAUGACGUG | 1560 |
| AD-1557881 | csusggagaadGadGgcucaucaccuL96 | 1130 | asdGsugau(G2p)agccdTcdTuuccagsgsg | 1357 | CCCUGGAGAAGAGGCUCAUCACC | 1561 |
| AD-1557882 | usgsgagaagadAgdGcucaucaccuL96 | 1131 | asdGsuga(Tgn)gagcdCudCuuccasgsg | 1358 | CCUGGAGAAGAGGCUCAUCACCU | 1562 |
| AD-1557883 | gsgsagaagadGgdCucaucaccuuL96 | 1132 | asdAsggug(Agn)ugagdCcdTcuuccsasg | 1359 | CUGGAGAAGAGGCUCAUCACCUC | 1563 |
| AD-1557884 | gsasgaagagdGcdTcaucaccucuL96 | 1133 | asdGsaggu(G2p)augadGcdCucuucscsa | 1360 | UGGAGAAGAGGCUCAUCACCUCG | 1564 |
| AD-1557886 | gsasagaggcdTcdAucaccucgguL96 | 1134 | asdCscgag(G2p)ugaudGadGccucuucsusc | 1361 | GAGAAGAGGCUCAUCACCUCGGU | 1565 |
| AD-1557890 | asgsgcucaudCadCcucgguguauL96 | 1135 | asdTsacac(C2p)gaggdTgdAugagccuscsu | 1362 | AGAGGCUCAUCACCUCGGUGUAC | 571 |
| AD-1557944 | gsasagaaggdGcdCugcacagcuuL96 | 1136 | asdAsgcug(Tgn)gcagdGcdCcuucuuscscs | 1363 | UGGAAGAAGGGCCUGCACAGCUA | 1566 |
| AD-1557945 | asasgaagggdCcdTgcacagcuauL96 | 1137 | asdTsagcu(G2p)ugcadGgdCccuucuuscsc | 1364 | GAAGAAGGGCCUGCACAGCUAC | 1567 |
| AD-1557948 | asasgggccudGcdAcagcuacuauL96 | 1138 | asdTsagua(G2p)cugudGcdAggcccuuscsu | 1365 | AGAAGGGCCUGCACAGCUACUAC | 1568 |
| AD-1557949 | asgsggccugdCadCagcuacuacuL96 | 1139 | asdGsuagu(Agn)gcugdTgdCaggcccususc | 1366 | GAAGGGCCUGCACAGCUACUACG | 1569 |
| AD-1557953 | cscsugcacadGcdTacuacgaccuL96 | 1140 | asdGsgucg(Tgn)agudGcdTgucaggscsc | 1367 | GGCCUGCACAGCUACUACGACCC | 573 |
| AD-1558059 | cscsucucugdGadCuacggcuuguL96 | 1141 | asdCsaagc(C2p)guagdTcdCagagaggsgsc | 1368 | GCCCUCUCUGGACUACGGCUUGG | 574 |
| AD-1558061 | uscsucuggadCudAcggcuuggcuL96 | 1142 | asdGsccaa(G2p)ccgudAgdTccagagasgsg | 1369 | CCUCUCUGGACUACGGCUUGGCC | 575 |
| AD-1558065 | usgsgacuacdGgdCuuggccucuuL96 | 1143 | asdGsaggg(C2p)caagdCcdGuaguccasgsa | 1370 | UCUGGACUACGGCUUGGCCCUCU | 1570 |
| AD-1558066 | gsgsacuacgdGcdTuggcccucuuL96 | 1144 | asdAsgagg(G2p)ccaadGcdCguaguccsasg | 1371 | CUGGACUACGGCUUGGCCCUCUG | 1571 |
| AD-1558105 | gsasgggaggcdAgdAaguaugauuuL96 | 1145 | asdAsauca(Tgn)acuudCdGccuccucscsasg | 1372 | CUGAGGAGGCAGAAGUAUGAUUU | 580 |
| AD-1558106 | asgsgaggcadGadAguaugauuuuL96 | 1146 | asdAsaauc(Agn)uacudTcdTgccuccuscscsa | 1373 | UGAGGAGGCAGAAGUAUGAUUUG | 1572 |
| AD-1558113 | asgsaaguaudGadTuugccgugcuL96 | 1147 | asdGscacg(G2p)caaadTcdAuacuucsgsc | 1374 | GCAGAAGUAUGAUUUGCCGUGCA | 587 |
| AD-1558114 | gsasaguaugdAudTugccgugcauL96 | 1148 | asdTsgcac(G2p)gcaadAudCauacuuscsusg | 1375 | CAGAAGUAUGAUUUGCCGUGCAC | 588 |
| AD-1558115 | asasguaugadTudTgccgugcacuL96 | 1149 | asdGsugca(C2p)ggcadAadTcauacuuscsu | 1376 | AGAAGUAUGAUUUGCCGUGCACC | 1573 |
| AD-1558116 | asgsuaugaudTudGccgugcaccuL96 | 1150 | asdGsugc(Agn)cggcdAadTcauacususcs | 1377 | GAAGUAUGAUUUGCCGUGCACCC | 1574 |
| AD-1558117 | gsusauguadTgdCcgugcacccuL96 | 1151 | asdGsggug(C2p)acggdCadAaucauacsusu | 1378 | AAGUAUGAUUUGCCGUGCACCCA | 1575 |
| AD-1558136 | gsgsccagugdGadCgauccagaauL96 | 1152 | asdTsucug(G2p)aucgdTcdCacuggccscsu | 1379 | AGGGCCAGUGGACGAUCCAGAAC | 1576 |
| AD-1558137 | gscscaguggdAcdGauccagaacuL96 | 1153 | asdGsuucu(G2p)gaucdGudCcacuggcscscs | 1380 | GGGCCAGUGGACGAUCCAGAACA | 1577 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1558138 | cscsagudggadCgdAuccagaacauL96 | 1154 | asdTsguuc(Tgn)ggaudCgdTccacuggscsc | 1381 | GGCCAGUGGACGAUCCAGAACAG | 1578 |
| AD-1558139 | csasguggacdGadTccagaacaguL96 | 1155 | asdCsuguu(C2p)uggadTcdGuccacugsgsc | 1382 | GCCAGUGGACGAUCCAGAACAGG | 589 |
| AD-1558142 | usgsgacgaudCcdAgaacaggaguL96 | 1156 | asdCsuccu(G2p)uucudGgdAucguccascsu | 1383 | AGUGGACGAUCCAGAACAGGAGG | 1579 |
| AD-1558150 | cscsagaacadGgdAggcugugugguL96 | 1157 | asdCsacac(Agn)gccudCcdTguucuggsasu | 1384 | AUCCAGAACAGGAGGCUGUGUGG | 591 |
| AD-1558152 | asgsaacaggdAgdGcugugugcuL96 | 1158 | asdGsccac(Agn)cagcdCudCcguucusgsg | 1385 | CCAGAACAGGAGGCUGUGUGGCU | 592 |
| AD-1558211 | ascsuucaccdTcdCcagaucuccuL96 | 1159 | asdGsgaga(Tgn)cuggdGadGgugaagususg | 1386 | CAACUUCACCUCCCAGAUCUCCC | 1580 |
| AD-1558215 | csasccucccdAgdAucccucauL96 | 1160 | asdTsgagg(G2p)agaudCudGggaggugsasa | 1387 | UUCACCUCCCAGAUCUCCCUCAC | 1581 |
| AD-1558230 | usgsugcgggdTgdCacuauggcuuL96 | 1161 | asdAsgcca(Tgn)agugdCadCccgcacascsc | 1388 | GGUGUGCGGGUGCACUAUGGCUU | 593 |
| AD-1558231 | gsusgcgggudGcdAcuauggcuuL96 | 1162 | asdAsagcc(Agn)uagudGcdAcccgcacsasc | 1389 | GUGUGCGGGUGCACUAUGGCUUG | 594 |
| AD-1558232 | usgscgggugdCadCuauggcuuguL96 | 1163 | asdCsaagc(C2p)auagdTgdCacccgcascsa | 1390 | UGUGCGGGUGCACUAUGGCUUGU | 1582 |
| AD-1558233 | gscsgggugcdAcdTauggcuuguuL96 | 1164 | asdAscaag(C2p)cauadGudGcacccgcsasc | 1391 | GUGCGGGUGCACUAUGGCUUGUA | 595 |
| AD-1558234 | csgsggugcadCudAuggcuuguauL96 | 1165 | asdTsacaa(G2p)ccaudAgdTgcacccgscsa | 1392 | UGCGGGUGCACUAUGGCUUGUAC | 1583 |
| AD-1558235 | gsgsgugcacdTadTggcuuguacuL96 | 1166 | asdGsuaca(Agn)gccadTadGugcacccsgsc | 1393 | GCGGGUGCACUAUGGCUUGUACA | 596 |
| AD-1558236 | gsgsugcacudAudGgcuuguacauL96 | 1167 | asdTsguac(Agn)agccdAudAgugcaccscsg | 1394 | CGGGUGCACUAUGGCUUGUACAA | 1584 |
| AD-1558238 | usgscacuaudGgdCuuguacaacuL96 | 1168 | asdGsuugu(Agn)caagdCcdAuagugcascsc | 1395 | GGUGCACUAUGGCUUGUACAACC | 1585 |
| AD-1558239 | gscsacuaugdGcdTuguacaaccuL96 | 1169 | asdGsguug(Tgn)acaadGcdCauagugcsasc | 1396 | GUGCACUAUGGCUUGUACAACCA | 1586 |
| AD-1558249 | csusgcccugdGadGaguuccucuuL96 | 1170 | asdAsgagg(Agn)acucdTcdCagggcagsgsg | 1397 | CCCUGCCCGGAGAGUUCCUCUG | 599 |
| AD-1558250 | usgscccuggdAgdAguuccucuguL96 | 1171 | asdCsagag(G2p)aacudCudCcaggcasgsg | 1398 | CCUGCCCGGAGAGUUCCUCUGU | 1587 |
| AD-1558288 | asascggccudGgdAugagagaaauL96 | 1172 | asdTsuucu(C2p)ucaudCcdAggccguusgsg | 1399 | CCAACGGCCUGGAUGAGAGAAAC | 1588 |
| AD-1558289 | ascsggccugdGadTgagagaaacuL96 | 1173 | asdGsuuuc(Tgn)cucadTcdCaggccgususg | 1400 | CAACGGCCUGGAUGAGAGAAACU | 1589 |
| AD-1558290 | csgsgccuggdAudGagagaaacuuL96 | 1174 | asdAsguuu(C2p)ucucdAudCcaggccgsusu | 1401 | AACGGCCUGGAUGAGAGAAACUG | 1590 |
| AD-1558292 | gscscuggaudGadGagaaacugcuL96 | 1175 | asdGscagu(Tgn)ucucdTcdAuccaggcscsg | 1402 | CGGCCUGGAUGAGAGAAACUGCG | 600 |
| AD-1558293 | cscsuggaugdAgdAgaaacugcuL96 | 1176 | asdCsgcag(Tgn)uucudCudCauccaggscsc | 1403 | GGCCUGGAUGAGAGAAACUGCGU | 1591 |
| AD-1558301 | asgsagaaacdTgdCguuugcagauL96 | 1177 | asdTscugc(Agn)aacgdCadGuuucucuscsa | 1404 | UGAGAGAAACUGCGUUUGCAGAG | 1592 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1558302 | gsasgaaacudGcd GuuugcagaguL96 | 1178 | asdCsucug(C2p)aaa cdGcdAguuucucsusc | 1405 | GAGAGAAACUGCGUUUGCAGAGC | 1593 |
| AD-1558308 | csusgcguuudGcd AgagccacauuL96 | 1179 | asdAsugug(G2p)cuc udGcdAaacgcagsusu | 1406 | AACUGCGUUUGCAGAGCCACAUU | 1594 |
| AD-1558309 | usgscguuugdCad GagccacauuuL96 | 1180 | asdAsaugu(G2p)gcu cdTgdCaaacgcasgsu | 1407 | ACUGCGUUUGCAGAGCCACAUUC | 1595 |
| AD-1558310 | gscsguuugcdAgd AgccacauucL96 | 1181 | asdGsaaug(Tgn)ggc udCudGcaaacgcasasg | 1408 | CUGCGUUUGCAGAGCCACAUUCC | 1596 |
| AD-1558311 | csgsuuugcadGad GccacauuccL96 | 1182 | asdGsgaau(G2p)ugg cdTcdTgcaaacgscsa | 1409 | UGCGUUUGCAGAGCCACAUUCCA | 1597 |
| AD-1558316 | gscsagagccdAcd AuuccagucuL96 | 1183 | asdGscacu(G2p)gaa udGudGgcucugcsasa | 1410 | UUGCAGAGCCACAUUCCAGUGCA | 1598 |
| AD-1558419 | usgsggacaudTcd AccuuccaguuL96 | 1184 | asdAscugg(Agn)agg udGadAugucccascsa | 1411 | UGUGGGACAUUCACCUUCCAGUG | 606 |
| AD-1558420 | gsgsgacauudCad CcuuccaguguL96 | 1185 | asdCsacug(G2p)aag gdTgdAaugucccasc | 1412 | GUGGGACAUUCACCUUCCAGUGU | 1599 |
| AD-1558421 | gsgsacauucdAcd CuuccaguguuL96 | 1186 | asdAscacu(G2p)gaa gdGudGaaugucccsa | 1413 | UGGGACAUUCACCUUCCAGUGUG | 607 |
| AD-1558423 | ascsauucacdCud TccagugugauL96 | 1187 | asdTscaca(C2p)ugg adAgdGugaauguscsc | 1414 | GGACAUUCACCUUCCAGUGUGAG | 609 |
| AD-1558449 | gsasgcugcgdTgd AagaagcccauL96 | 1188 | asdTsgggc(Tgn)ucu udCadCgcagcucscsg | 1415 | CGGAGCUGCGUGAAGAAGCCCAA | 1600 |
| AD-1558450 | asgscugcgudGad AgaagcccaauL96 | 1189 | asdTsuggg(C2p)uuc udTcdAcgcagcuscsc | 1416 | GGAGCUGCGUGAAGAAGCCCAAC | 1601 |
| AD-1558451 | gscsugcgugdAad GaagcccaauuL96 | 1190 | asdGsuugg(G2p)cuu cdTudCacgcagcsusc | 1417 | GAGCUGCGUGAAGAAGCCCAACC | 1602 |
| AD-1558452 | csusgcgugadAgd AagcccaaccuL96 | 1191 | asdGsguug(G2p)gcu udCudTcacgcagscsu | 1418 | AGCUGCGUGAAGAAGCCCAACCC | 1603 |
| AD-1558453 | usgscgugaadGad AgcccaacccuL96 | 1192 | asdGsgguu(G2p)ggc udTcdTucacgcasgsc | 1419 | GCUGCGUGAAGAAGCCCAACCCG | 1604 |
| AD-1558508 | asgscacugudGad CugugccucuL96 | 1193 | asdGsaggc(C2p)aca gdTcdAcagugcuscsc | 1420 | GGAGCACUGUGACUGUGGCCUCC | 1605 |
| AD-1558546 | csusccgaggdGud GaguggccauuL96 | 1194 | asdAsuggc(C2p)acu cdAcdCcucggagsgsa | 1421 | UCCUCCGAGGGUGAGUGGCCAUG | 1606 |
| AD-1558576 | asuscgcugadCcd GcugggugauuL96 | 1195 | asdAsucac(C2p)cag cdGgdTcagcgausgsa | 1422 | UCAUCGCUGACCGCUGGGUGAUA | 611 |
| AD-1558577 | uscsgcugacdCgd CugggugauauL96 | 1196 | asdTsauca(C2p)cca gdCgdGucagcgasusg | 1423 | CAUCGCUGACCGCUGGGUGAUAA | 1607 |
| AD-1558578 | csgscugaccdGcd TgggugauaauL96 | 1197 | asdTsuauc(Agn)ccc adGcdGgucagcgsasu | 1424 | AUCGCUGACCGCUGGGUGAUAAC | 1608 |
| AD-1558579 | gscsugaccgdCud GggugauaacuL96 | 1198 | asdGsuuau(C2p)acc cdAgdCggucagcsgsa | 1425 | UCGCUGACCGCUGGGUGAUAACA | 1609 |
| AD-1558586 | gscsugggugdAud AacagcugccuL96 | 1199 | asdGsgcag(C2p)ugu udAudCacccagcsgsg | 1426 | CCGCUGGGUGAUAACAGCUGCCC | 1610 |
| AD-1558609 | usgscuuccadGgd AggacagcauuL96 | 1200 | asdAsugcu(G2p)ucc udCcdTggaagcasgsu | 1427 | ACUGCUUCCAGGAGGACAGCAUG | 1611 |
| AD-1558610 | gscsuuccagdGad GgacagcauguL96 | 1201 | asdCsaugc(Tgn)guc cdTcdCuggaagcsasg | 1428 | CUGCUUCCAGGAGGACAGCAUGG | 1612 |
| AD-1558611 | csusuccaggdAgd GacagcauguuL96 | 1202 | asdCscaug(C2p)ugu cdCudCcuggaagscsa | 1429 | UGCUUCCAGGAGGACAGCAUGGC | 1613 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1558650 | csgsguuccdTgdGgcaaggguguuL96 | 1203 | asdAscacc(Tgn)ugccdCadGgaacacgsgsu | 1430 | ACCGUGUUCCUGGGCAAGGUGUG | 613 |
| AD-1558657 | csusgggcaadGgdTguggcagaauL96 | 1204 | asdTsucug(C2p)cacadCcdTugcccagsgsa | 1431 | UCCUGGGCAAGGUGUGGCAGAAC | 1614 |
| AD-1558658 | usgsggcaagdGudGuggcagaacuL96 | 1205 | asdGsuucu(G2p)ccacdAcdCuugcccasgsg | 1432 | CCUGGGCAAGGUGUGGCAGAACU | 1615 |
| AD-1558659 | gsgsgcaaggdTgdTggcagaacuuL96 | 1206 | asdAsguuc(Tgn)gccadCadCcuugcccsasg | 1433 | CUGGGCAAGGUGUGGCAGAACUC | 1616 |
| AD-1558660 | gsgscaaggudGudGgcagaacucuL96 | 1207 | asdGsaguu(C2p)ugccdAcdAccuugccscsa | 1434 | UGGGCAAGGUGUGGCAGAACUCG | 1617 |
| AD-1558661 | gscsaaggugdTgdGcagaacucguL96 | 1208 | asdCsgagu(Tgn)cugcdCadCaccuugcscsc | 1435 | GGGCAAGGUGUGGCAGAACUCGC | 615 |
| AD-1558662 | csasaggugudGgdCagaacucgcuL96 | 1209 | asdGscgag(Tgn)ucugdCcdAcaccuugscsc | 1436 | GGCAAGGUGUGGCAGAACUCGCG | 1618 |
| AD-1558683 | usgsgccuggdAgdAggugccuuuL96 | 1210 | asdAsagga(C2p)accudCudCcaggccasgsc | 1437 | GCUGGCCUGGAGAGGUGUCCUUC | 1619 |
| AD-1558684 | gsgsccuggadGadGguguccuucuL96 | 1211 | asdGsaagg(Agn)caccdTcdTccaggccsasg | 1438 | CUGGCCUGGAGAGGUGUCCUUCA | 1620 |
| AD-1558685 | gscscuggagdAgdGuguccuucauL96 | 1212 | asdTsgaag(G2p)acacdCudCuccaggcscsa | 1439 | UGGCCUGGAGAGGUGUCCUUCAA | 1621 |
| AD-1558686 | cscsuggagadGgdTguccuucaauL96 | 1213 | asdTsugaa(G2p)gacadCcdTccaggscscsc | 1440 | GGCCUGGAGAGGUGUCCUUCAAG | 1622 |
| AD-1558687 | csusggagagdGudGuccuucaaguL96 | 1214 | asdCsuuga(Agn)ggacdAcdCucuccagsgsc | 1441 | GCCUGGAGAGGUGUCCUUCAAGG | 617 |
| AD-1558691 | asgsaggugudCcdTucaaggugauL96 | 1215 | asdTscacc(Tgn)ugaadGgdAcaccucuscsc | 1442 | GGAGAGGUGUCCUUCAAGGUGAG | 620 |
| AD-1558833 | usgsugcagudTgdAucccacagguL96 | 1216 | asdCscugu(G2p)ggaudCadAcugcacasusc | 1443 | GAUGUGCAGUUGAUCCCACAGGA | 1623 |
| AD-1558835 | usgscaguugdAudCccacaggacuL96 | 1217 | asdGsuccu(G2p)ugggdAudCaacugcascsa | 1444 | UGUGCAGUUGAUCCCACAGGACC | 1624 |
| AD-1558843 | asusccacadGgdAccugugcaguL96 | 1218 | asdCsugca(C2p)aggudCcdTugggauscsa | 1445 | UGAUCCCACAGGACCUGUGCAGC | 621 |
| AD-1558845 | cscscacaggdAcdCugugcagcguL96 | 1219 | asdCsgcug(C2p)acagdGudCcugugggsasu | 1446 | AUCCCACAGGACCUGUGCAGCGA | 1625 |
| AD-1558846 | cscsacaggadCcdTgugcagcgauL96 | 1220 | asdTscgcu(G2p)cacadGgdTccugugssgsa | 1447 | UCCCACAGGACCUGUGCAGCGAG | 1626 |
| AD-1558878 | cscsaggugadCgdCcacgcaugcuL96 | 1221 | asdGscaug(C2p)gugdCgdTcaccuggsusa | 1448 | UACCAGGUGACGCCACGCAUGCU | 1627 |
| AD-1558882 | gsusgacgccdAcdGcaugcuguguL96 | 1222 | asdCsacag(C2p)augcdGudGgcgucacscsu | 1449 | AGGUGACGCCACGCAUGCUGUGU | 1628 |
| AD-1558883 | usgsacgccadCgdCaugcuguguuL96 | 1223 | asdAscaca(G2p)caudGcdGuggcgucascsc | 1450 | GGUGACGCCACGCAUGCUGUGUG | 622 |
| AD-1558885 | ascsgccacgdCadTgcugugugcuL96 | 1224 | asdGscaca(C2p)agcadTgdCgguggcguscsa | 1451 | UGACGCCACGCAUGCUGUGUGCC | 1629 |
| AD-1558905 | gsgscuaccgdCadAgggcaagaauL96 | 1225 | asdTsucuu(G2p)cccudTgdCgguagccsgsg | 1452 | CCGGCUACCGCAAGGGCAAGAAG | 1630 |
| AD-1558906 | gscsuaccgcdAadGggcaagaaguL96 | 1226 | asdCsuucu(Tgn)gcccdTudCgguagcscsg | 1453 | CGGCUACCGCAAGGGCAAGAAGG | 624 |
| AD-1558907 | csusaccgcadAgdGgcaagaagguL96 | 1227 | asdCscuuc(Tgn)ugccdCudTgcgguagscsc | 1454 | GGCUACCGCAAGGGCAAGAAGGA | 625 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1558961 | gsusgcaaggdCadCucagugccuL96 | 1228 | asdGsgcca(C2p)ugagdTgdCcuugcacsasc | 1455 | GUGUGCAAGGCACUCAGUGGCCG | 1631 |
| AD-1558992 | csusaacuacdTudCggcgucuacuL96 | 1229 | asdGsuaga(C2p)gccgdAadGuaguuagsgsc | 1456 | GCCUAACUACUUCGGCGUCUACA | 1632 |
| AD-1558995 | ascsuacuucdGgdCgucuacaccuL96 | 1230 | asdGsgugu(Agn)gacgdCcdGaaguagususa | 1457 | UAACUACUUCGGCGUCUACACCC | 1633 |
| AD-1558996 | csusacuucgdGcdGucuacacccuL96 | 1231 | asdGsggug(Tgn)agacdGcdCgaaguagsusu | 1458 | AACUACUUCGGCGUCUACACCCG | 1634 |
| AD-1559004 | gscsgucuacdAcdCcgcaucacauL96 | 1232 | asdTsguga(Tgn)gcggdGudGuagacgcscsg | 1459 | CGGCGUCUACACCCGCAUCACAG | 1635 |
| AD-1559005 | csgsucuacadCcdCgcaucacaguL96 | 1233 | asdCsugug(Agn)ugcgdGgdTguagacgcscsc | 1460 | GGCGUCUACACCCGCAUCACAGG | 1636 |
| AD-1559008 | csusacacccdGcdAucacaggguguL96 | 1234 | asdCsaccu(G2p)ugaudGcdGgguguagsasc | 1461 | GUCUACACCCGCAUCACAGGUGU | 628 |
| AD-1559012 | ascsccgcaudCadCaggugugauuL96 | 1235 | asdAsucac(Agn)ccugdTgdAugcgggusgsu | 1462 | ACACCCGCAUCACAGGUGUGAUC | 1637 |
| AD-1559013 | cscscgcaucdAcdAggugugaucuL96 | 1236 | asdGsauca(C2p)accudGudGaugcgggsusg | 1463 | CACCCGCAUCACAGGUGUGAUCA | 1638 |
| AD-1559036 | usgsgauccadGcdAaguggugacuL96 | 1237 | asdGsucac(C2p)acuudGcdTggauccasgsc | 1464 | GCUGGAUCCAGCAAGUGGUGACC | 1639 |
| AD-1559038 | gsasuccagcdAadGuggugaccuuL96 | 1238 | asdAsgguc(Agn)ccacdTudGcuggaucscsa | 1465 | UGGAUCCAGCAAGUGGUGACCUG | 1640 |
| AD-1559039 | asusccagcadAgdTggugaccuguL96 | 1239 | asdCsaggu(C2p)accadCudTgcuggauscsc | 1466 | GGAUCCAGCAAGUGGUGACCUGA | 1641 |
| AD-1559041 | cscsagcaagdTgdGugaccgaguL96 | 1240 | asdCsucag(G2p)ucacdCadCuugcuggsasu | 1467 | AUCCAGCAAGUGGUGACCUGAGG | 1642 |
| AD-1559042 | csasgcaagudGgdTgaccugagguL96 | 1241 | asdCsucuca(G2p)gucadCcdAcuugcugsgsa | 1468 | UCCAGCAAGUGGUGACCUGAGGA | 1643 |
| AD-1559044 | gscsaagugdTgdAccugaggaauL96 | 1242 | asdTsuccu(C2p)aggudCadCcacuugcsusg | 1469 | CAGCAAGUGGUGACCUGAGGAAC | 1644 |
| AD-1559105 | usgsguggcadGgdAgguggcaucuL96 | 1243 | asdGsaugc(C2p)accudCcdTgccaccascsa | 1470 | UGUGGUGGCAGGAGGUGGCAUCU | 1645 |
| AD-1559106 | gsgsuggcagdGadGguggcaucuuL96 | 1244 | asdAsgaug(C2p)caccdTcdCugccaccsasc | 1471 | GUGGUGGCAGGAGGUGGCAUCUU | 1646 |
| AD-1559107 | gsusggcaggdAgdGuggcaucuuuL96 | 1245 | asdAsagau(G2p)ccacdCudCugccacscsa | 1472 | UGGUGGCAGGAGGUGGCAUCUUG | 1647 |
| AD-1559109 | gsgscaggagdGudGgcaucuuguuL96 | 1246 | asdAscaag(Agn)ugccdAcdCuccugccsasc | 1473 | GUGGCAGGAGGUGGCAUCUUGUC | 631 |
| AD-1559133 | uscsccugaudGudCugcuccaguuL96 | 1247 | asdAscugg(Agn)gcagdAcdAucagggascsg | 1474 | CGUCCCUGAUGUCUGCUCCAGUG | 1648 |
| AD-1559136 | csusgaugucdTgdCuccagugauuL96 | 1248 | asdAsucac(Tgn)ggagdCadGacaucagsgsg | 1475 | CCCUGAUGUCUGCUCCAGUGAUG | 1649 |
| AD-1559147 | uscscagugadTgdGcaggaggauuL96 | 1249 | asdAsuccu(C2p)cugcdCadTcacuggasgsc | 1476 | GCUCCAGUGAUGGCAGGAGGAUG | 1650 |
| AD-1559233 | gsgscucagcdAgdCaagaaugcuuL96 | 1250 | asdAsgcau(Tgn)cuugdCudGcgagccsasc | 1477 | GUGGCUCAGCAGCAAGAAUGCUG | 636 |
| AD-1559318 | csusaacuugdGgdAucugggaauuL96 | 1251 | asdAsuucc(C2p)agaudCcdCaaguuagsasc | 1478 | GUCUAACUUGGGAUCUGGGAAUG | 1651 |
| AD-1559323 | ususgggaucdTgdGgaauggaaguL96 | 1252 | asdCsuucc(Agn)uucdCadGaucccaasgsu | 1479 | ACUUGGGAUCUGGGAAUGGAAGG | 642 |

TABLE 5-continued

Modified Sense and Antisense Strand Sequences of TMPRSS6 dsRNA Agents

| Duplex Name | Sense Sequence 5' to 3' | SEQ ID NO | Antisense Sequence 5' to 3' | SEQ ID NO | mRNA target sequence 5' to 3' | SEQ ID NO |
|---|---|---|---|---|---|---|
| AD-1559431 | gsusgagcucdAgdCugcccuuuguL96 | 1253 | asdCsaaag(G2p)gcagdCudGagcucacscsu | 1480 | AGGUGAGCUCAGCUGCCCUUUGG | 1652 |
| AD-1559436 | csuscagcugdCcdCuuuggaauauL96 | 1254 | asdTsauuc(C2p)aaagdGgdCagcugagscsu | 1481 | AGCUCAGCUGCCCUUUGGAAUAA | 1653 |
| AD-1559437 | uscsagcugcdCcdTuuggaauaauL96 | 1255 | asdTsuauu(C2p)caaadGgdCagcugasgsc | 1482 | GCUCAGCUGCCCUUUGGAAUAAA | 1654 |
| AD-1559438 | csasgcugccdCudTuggaauaaauL96 | 1256 | asdTsuuau(Tgn)ccaadAgdGgcagcugsasg | 1483 | CUCAGCUGCCCUUUGGAAUAAAG | 1655 |
| AD-1559441 | csusgcccuudTgdGaauaaagcuuL96 | 1257 | asdAsgcuu(Tgn)auucdCadAagggcagscsu | 1484 | AGCUGCCCUUUGGAAUAAAGCUG | 648 |
| AD-1559443 | gscsccuuugdGadAuaaagcugcuL96 | 1258 | asdGscagc(Tgn)uuaudTcdCaaagggcsasg | 1485 | CUGCCCUUUGGAAUAAAGCUGCC | 1656 |
| AD-1559444 | cscscuuuggdAadTaaagcugccuL96 | 1259 | asdGscag(C2p)uuuadTudCcaaagggscsa | 1486 | UGCCCUUUGGAAUAAAGCUGCCU | 1657 |
| AD-1559445 | cscsuuuggadAudAaagcugccuuL96 | 1260 | asdAsggca(G2p)cuuudAudTccaaaggsgsc | 1487 | GCCCUUUGGAAUAAAGCUGCCUG | 1658 |
| AD-1559447 | ususuggaaudAadAgcugccugauL96 | 1261 | asdTscagg(C2p)agcudTudAuuccaaasgsg | 1488 | CCUUUGGAAUAAAGCUGCCUGAU | 1659 |
| AD-1559448 | ususggaauadAadGcugccugauuL96 | 1262 | asdAsucag(G2p)cagcdTudTauuccaasasg | 1489 | CUUUGGAAUAAAGCUGCCUGAUC | 1660 |
| AD-1559449 | usgsgaauauadAgdCugccugaucuL96 | 1263 | asdGsauca(G2p)gcagdCudTuauuccasasa | 1490 | UUUGGAAUAAAGCUGCCUGAUCC | 1661 |

TABLE 6

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1570929.1 | CGGAGGUGAUGGCGAGGAAGU | 189-209 | 650 | ACUUCCUCGCCAUCACCUCCGUC | 187-209 | 848 |
| AD-1570930.1 | CCUGUGAGGACUCCAAGAGAU | 233-253 | 654 | AUCUCUUGGAGUCCUCACAGGCC | 231-253 | 1726 |
| AD-1570931.1 | CUGUGAGGACUCCAAGAGAAU | 234-254 | 1662 | AUUCUCUGGAGUCCUCACAGGC | 232-254 | 1727 |
| AD-1570932.1 | CUCUGGUAUUUCCUAGGGUAU | 331-351 | 28 | AUACCCUAGGAAAUACCAGAGUA | 329-351 | 1728 |
| AD-1570933.1 | GGUAUUUCCUAGGGUACAAGU | 335-355 | 660 | ACUUGUACCCUAGGAAAUACCAG | 333-355 | 858 |
| AD-1570934.1 | GUAUUUCCUAGGGUACAAGGU | 336-356 | 1663 | ACCUUGUACCCUAGGAAAUACCA | 334-356 | 1729 |
| AD-1570935.1 | GGUCAGCCAGGUGUACUCAGU | 366-386 | 31 | ACUGAGUACACCUGGCUGACCAU | 364-386 | 157 |
| AD-1570936.1 | UCAGCCAGGUGUACUCAGGCU | 368-388 | 665 | AGCCUGAGUACACCUGGCUGACC | 366-388 | 1730 |
| AD-1570937.1 | AGCCAGGUGUACUCAGGCAGU | 370-390 | 32 | ACUGCCUGAGUACACCUGGCUGA | 368-390 | 158 |
| AD-1570938.1 | CACUUCUCCCAGGAUCUUACU | 409-429 | 670 | AGUAAGAUCCUGGGAGAAGUGGC | 407-429 | 867 |
| AD-1570939.1 | UCUCCCAGGAUCUUACCCGCU | 413-433 | 1664 | AGCGGGUAAGAUCCUGGGAGAAG | 411-433 | 1731 |
| AD-1570940.1 | GCCUUCCGCAGUGAAACCGCU | 445-465 | 36 | AGCGGUUCACUGCGGAAGGCAC | 443-465 | 1732 |
| AD-1570941.1 | CCUUCCGCAGUGAAACCGCCU | 446-466 | 1665 | AGGCGGUUCACUGCGGAAGGCA | 444-466 | 872 |
| AD-1570942.1 | GCAGUGAAACCGCCAAAGCCU | 452-472 | 679 | AGGCUUUGGCGGUUUCACUGCGG | 450-472 | 1733 |
| AD-1570943.1 | CAGUGAAACCGCCAAAGCCCU | 453-473 | 680 | AGGGCUUGGCGGUUUCACUGCG | 451-473 | 1734 |

TABLE 6-continued

Unmofidied Sense and Antisense Strand Sequences of TMPRSS6 dsRNA Agents

| Duplex Name | Sense Strand Sequence 5' to 3' | Range in NM_ 153609.4 | SEQ ID NO: | Antisense Strand Sequence 5' to 3' | Range in NM_ 153609.4 | SEQ ID NO: |
|---|---|---|---|---|---|---|
| AD-1570944.1 | AGUGAAACCGCCAAAGCCCAU | 454-474 | 681 | AUGGGCUUUGGCGGUUUCACUGC | 452-474 | 1735 |
| AD-1570945.1 | CGCCAAAGCCCAGAAGAUGCU | 462-482 | 682 | AGCAUCUUCUGGGCUUUGGCGGU | 460-482 | 1736 |
| AD-1570946.1 | AGCCCAGAAGAUGCUCAAGGU | 468-488 | 684 | ACCUUGAGCAUCUUCUGGGCUUU | 466-488 | 1737 |
| AD-1570947.1 | AGCACCCGCCUGGGAACUUAU | 499-519 | 1666 | AUAAGUUCCCAGGCGGGUGCUGG | 497-519 | 1738 |
| AD-1570948.1 | CAACUCCAGCUCCGUCUAUUU | 522-542 | 37 | AAAUAGACGGAGCUGGAGUUGUA | 520-542 | 163 |
| AD-1570949.1 | UCACCUGCUUCUUCUGGUUCU | 560-580 | 40 | AGAACCAGAAGAAGCAGGUGAGG | 558-580 | 166 |
| AD-1570950.1 | CCUGCUUCUUCUGGUUCAUUU | 563-583 | 42 | AAAUGAACCAGAAGAAGCAGGUG | 561-583 | 168 |
| AD-1570951.1 | CUGCUUCUUCUGGUUCAUUCU | 564-584 | 1667 | AGAAUGAACCAGAAGAAGCAGGU | 562-584 | 1739 |
| AD-1570952.1 | CUUCUUCUGGUUCAUUCUCCU | 567-587 | 45 | AGGAGAAUGAACCAGAAGAAGCA | 565-587 | 171 |
| AD-1570953.1 | UUCUUCUGGUUCAUUCUCCAU | 568-588 | 46 | AUGGAGAAUGAACCAGAAGAAGC | 566-588 | 1740 |
| AD-1570954.1 | CUUCUGGUUCAUUCUCCAAAU | 570-590 | 1668 | AUUUGGAGAAUGAACCAGAAGAA | 568-590 | 1741 |
| AD-1570955.1 | CUGGUUCAUUCUCCAAAUCCU | 573-593 | 47 | AGGAUUUGGAGAAUGAACCAGAA | 571-593 | 173 |
| AD-1570956.1 | GCUGCUGUCCACAGUCAACAU | 651-671 | 703 | AUGUUGACUGUGGACAGCAGCUC | 649-671 | 1742 |
| AD-1570957.1 | GCUGUCCACAGUCAACAGCUU | 654-674 | 704 | AAGCUGUUGACUGUGGACAGCAG | 652-674 | 1743 |
| AD-1570958.1 | UGUCCACAGUCAACAGCUCGU | 656-676 | 706 | ACGAGCUGUUGACUGUGGACAGC | 654-676 | 1744 |
| AD-1570959.1 | GGCCGAGUACGAAGUGGACCU | 693-713 | 708 | AGGUCCACUUCGUACUCGGCCCU | 691-713 | 902 |
| AD-1570960.1 | AUCCUGGAAGCCAGUGUGAAU | 727-747 | 709 | AUUCACACUGGCUUCCAGGAUCA | 725-747 | 1745 |
| AD-1570961.1 | CCUGGAAGCCAGUGUGAAAGU | 729-749 | 711 | ACUUUCACACUGGCUUCCAGGAU | 727-749 | 1746 |
| AD-1570962.1 | UGGAAGCCAGUGUGAAAGACU | 731-751 | 1669 | AGUCUUUCACACUGGCUUCCAGG | 729-751 | 1747 |
| AD-1570963.1 | GGAAGCCAGUGUGAAAGACAU | 732-752 | 714 | AUGUCUUUCACACUGGCUUCCAG | 730-752 | 1748 |
| AD-1570964.1 | GAAGCCAGUGUGAAAGACAUU | 733-753 | 1670 | AAUGUCUUUCACACUGGCUUCCA | 731-753 | 1749 |
| AD-1570965.1 | AGCCAGUGUGAAAGACAUAGU | 735-755 | 1671 | ACUAUGUCUUUCACACUGGCUUC | 733-755 | 1750 |
| AD-1570966.1 | CCAGUGUGAAAGACAUAGCUU | 737-757 | 50 | AAGCUAUGUCUUUCACACUGGCU | 735-757 | 1751 |
| AD-1570967.1 | AGUGUGAAAGACAUAGCUGCU | 739-759 | 719 | AGCAGCUAUGUCUUUCACACUGG | 737-759 | 1752 |
| AD-1570968.1 | GUGAAAGACAUAGCUGCAUUU | 742-762 | 1672 | AAAUGCAGCUAUGUCUUUCACAC | 740-762 | 1753 |
| AD-1570969.1 | AUUGAAUUCCACGCUGGGUUU | 759-779 | 52 | AAACCCAGCGUGGAAUUCAAUGC | 757-779 | 178 |
| AD-1570970.1 | AAUUCCACGCUGGGUUGUUAU | 763-783 | 55 | AUAACAACCCAGCGUGGAAUUCA | 761-783 | 1754 |
| AD-1570971.1 | CACGCUGGGUUGUUACCGCUU | 768-788 | 58 | AAGCGGUAACAACCCAGCGUGGA | 766-788 | 184 |
| AD-1570972.1 | UGGGUUGUUACCGCUACAGCU | 773-793 | 1673 | AGCUGUAGCGGUAACAACCCAGC | 771-793 | 1755 |
| AD-1570973.1 | GGGUUGUUACCGCUACAGCUU | 774-794 | 730 | AAGCUGUAGCGGUAACAACCCAG | 772-794 | 1756 |
| AD-1570974.1 | CAAACUCCGGCUGGAGUGGAU | 888-908 | 731 | AUCCACUCCAGCCGGAGUUUGAG | 886-908 | 1757 |
| AD-1570975.1 | GGGACCGACUGGCCAUGUAUU | 923-943 | 60 | AAUACAUGGCCAGUCGGUCCCGG | 921-943 | 186 |
| AD-1570976.1 | CGACUGGCCAUGUAUGACGUU | 928-948 | 1674 | AACGUCAUACAUGGCCAGUCGGU | 926-948 | 1758 |
| AD-1570977.1 | UGGAGAAGAGGCUCAUCACCU | 959-979 | 734 | AGGUGAUGAGCCUCUUCUCCAGG | 957-979 | 928 |
| AD-1570978.1 | GGAGAAGAGGCUCAUCACCUU | 960-980 | 735 | AAGGUGAUGAGCCUCUUCUCCAG | 958-980 | 1759 |
| AD-1570979.1 | GAAGAGGGCCUGCACAGCUUU | 1053-1073 | 738 | AAGCUGUGCAGGCCCUUCUUCCA | 1051-1073 | 1760 |
| AD-1570980.1 | AGGGCCUGCACAGCUACUACU | 1058-1078 | 741 | AGUAGUAGCUGUGCAGGCCCUUC | 1056-1078 | 1761 |

TABLE 6-continued

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1570981.1 | CCUGCACAGCUACUACGACCU | 1062-1082 | 69 | AGGUCGUAGUAGCUGUGCAGGCC | 1060-1082 | 195 |
| AD-1570982.1 | GAGGAGGCAGAAGUAUGAUUU | 1281-1301 | 76 | AAAUCAUACUUCUGCCUCCUCAG | 1279-1301 | 202 |
| AD-1570983.1 | AGGAGGCAGAAGUAUGAUUUU | 1282-1302 | 745 | AAAAUCAUACUUCUGCCUCCUCA | 1280-1302 | 1762 |
| AD-1570984.1 | AGUAUGAUUUGCCGUGCACCU | 1292-1312 | 1675 | AGGUGCACGGCAAAUCAUACUUC | 1290-1312 | 942 |
| AD-1570985.1 | CCAGUGGACGAUCCAGAACAU | 1317-1337 | 753 | AUGUUCUGGAUCGUCCACUGGCC | 1315-1337 | 1763 |
| AD-1570986.1 | CCAGAACAGGAGGCUGUGUGU | 1329-1349 | 87 | ACACACAGCCUCCUGUUCUGGAU | 1327-1349 | 213 |
| AD-1570987.1 | AGAACAGGAGGCUGUGUGGCU | 1331-1351 | 88 | AGCCACACAGCCUCCUGUUCUGG | 1329-1351 | 214 |
| AD-1570988.1 | ACUUCACCUCCCAGAUCUCCU | 1415-1435 | 1676 | AGGAGAUCUGGGAGGUGAAGUUG | 1413-1435 | 950 |
| AD-1570989.1 | UGUGCGGGUGCACUAUGGCUU | 1449-1469 | 89 | AAGCCAUAGUGCACCCGCACACC | 1447-1469 | 215 |
| AD-1570990.1 | GUGCGGGUGCACUAUGGCUUU | 1450-1470 | 90 | AAAGCCAUAGUGCACCCGCACAC | 1448-1470 | 216 |
| AD-1570991.1 | GGGUGCACUAUGGCUUGUACU | 1454-1474 | 92 | AGUACAAGCCAUAGUGCACCCGC | 1452-1474 | 1764 |
| AD-1570992.1 | GGUGCACUAUGGCUUGUACAU | 1455-1475 | 763 | AUGUACAAGCCAUAGUGCACCCG | 1453-1475 | 1765 |
| AD-1570993.1 | UGCACUAUGGCUUGUACAACU | 1457-1477 | 764 | AGUUGUACAAGCCAUAGUGCACC | 1455-1477 | 955 |
| AD-1570994.1 | GCACUAUGGCUUGUACAACCU | 1458-1478 | 1677 | AGGUUGUACAAGCCAUAGUGCAC | 1456-1478 | 1766 |
| AD-1570995.1 | CUGCCCUGGAGAGUUCCUCUU | 1488-1508 | 95 | AAGAGGAACUCUCCAGGGCAGGG | 1486-1508 | 1767 |
| AD-1570996.1 | ACGGCCUGGAUGAGAGAAACU | 1562-1582 | 1678 | AGUUUCUCUCAUCCAGGCCGUUG | 1560-1582 | 1768 |
| AD-1570997.1 | GCCUGGAUGAGAGAAACUGCU | 1565-1585 | 96 | AGCAGUUUCUCUCAUCCAGGCCG | 1563-1585 | 1769 |
| AD-1570998.1 | CCUGGAUGAGAGAAACUGCGU | 1566-1586 | 770 | ACGCAGUUUCUCUCAUCCAGGCC | 1564-1586 | 961 |
| AD-1570999.1 | AGAGAAACUGCGUUUGCAGAU | 1574-1594 | 1679 | AUCUGCAAACGCAGUUUCUCUCA | 1572-1594 | 1770 |
| AD-1571000.1 | GCGUUUGCAGAGCCACAUUCU | 1583-1603 | 775 | AGAAUGUGGCUCUGCAAACGCAG | 1581-1603 | 1771 |
| AD-1571001.1 | UGGGACAUUCACCUUCCAGUU | 1710-1730 | 102 | AACUGGAAGGUGAAUGUCCCACA | 1708-1730 | 228 |
| AD-1571002.1 | GAGCUGCGUGAAGAAGCCCAU | 1740-1760 | 1680 | AUGGGCUUCUUCACGCAGCUCCG | 1738-1760 | 1772 |
| AD-1571003.1 | CGCUGACCGCUGGGUGAUAAU | 1938-1958 | 1681 | AUUAUCACCCAGCGGUCAGCGAU | 1936-1958 | 1773 |
| AD-1571004.1 | GCUUCCAGGAGGACAGCAUGU | 1970-1990 | 793 | ACAUGCUGUCCUCCUGGAAGCAG | 1968-1990 | 1774 |
| AD-1571005.1 | CGUGUUCCUGGGCAAGGUGUU | 2010-2030 | 109 | AACACCUUGCCCAGGAACACGGU | 2008-2030 | 235 |
| AD-1571006.1 | GGGCAAGGUGUGGCAGAACUU | 2019-2039 | 1682 | AAGUUCUGCCACACCUUGCCCAG | 2017-2039 | 1775 |
| AD-1571007.1 | GCAAGGUGUGGCAGAACUCGU | 2021-2041 | 111 | ACGAGUUCUGCCACACCUUGCCC | 2019-2041 | 237 |
| AD-1571008.1 | CAAGGUGUGGCAGAACUCGCU | 2022-2042 | 801 | AGCGAGUUCUGCCACACCUUGCC | 2020-2042 | 989 |
| AD-1571009.1 | GGCCUGGAGAGGUGUCCUUCU | 2045-2065 | 803 | AGAAGGACACCUCUCCAGGCCAG | 2043-2065 | 1776 |
| AD-1571010.1 | CUGGAGAGGUGUCCUUCAAGU | 2048-2068 | 113 | ACUUGAAGGACACCUCUCCAGGC | 2046-2068 | 239 |
| AD-1571011.1 | AGAGGUGUCCUUCAAGGUGAU | 2052-2072 | 116 | AUCACCUUGAAGGACACCUCUCC | 2050-2072 | 1777 |
| AD-1571012.1 | GCUACCGCAAGGGCAAGAAGU | 2363-2383 | 120 | ACUUCUUGCCCUUGCGGUAGCCG | 2361-2383 | 1778 |
| AD-1571013.1 | CUACCGCAAGGGCAAGAAGGU | 2364-2384 | 121 | ACCUUCUUGCCCUUGCGGUAGCC | 2362-2384 | 247 |
| AD-1571014.1 | ACUACUUCGGCGUCUACACCU | 2489-2509 | 817 | AGGUGUAGACGCCGAAGUAGUUA | 2487-2509 | 1007 |
| AD-1571015.1 | CUACUUCGGCGUCUACACCCU | 2490-2510 | 818 | AGGGUGUAGACGCCGAAGUAGUU | 2488-2510 | 1779 |
| AD-1571016.1 | GCGUCUACACCCGCAUCACAU | 2498-2518 | 819 | AUGUGAUGCGGGUGUAGACGCCG | 2496-2518 | 1780 |
| AD-1571017.1 | CGUCUACACCCGCAUCACAGU | 2499-2519 | 820 | ACUGUGAUGCGGGUGUAGACGCC | 2497-2519 | 1781 |

TABLE 6-continued

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1571018.1 | ACCCGCAUCACAGGUGUGAUU | 2506-2526 | 821 | AAUCACACCUGUGAUGCGGGUGU | 2504-2526 | 1782 |
| AD-1571019.1 | GAUCCAGCAAGUGGUGACCUU | 2532-2552 | 824 | AAGGTCACCACUUGCUGGAUCCA | 2530-2552 | 1783 |
| AD-1571020.1 | GGCAGGAGGUGGCAUCUUGUU | 2671-2691 | 127 | AACAAGAUGCCACCUCCUGCCAC | 2669-2691 | 253 |
| AD-1571021.1 | UCCCUGAUGUCUGCUCCAGUU | 2695-2715 | 832 | AACUGGAGCAGACAUCAGGGACG | 2693-2715 | 1022 |
| AD-1571022.1 | CUGAUGUCUGCUCCAGUGAUU | 2698-2718 | 1683 | AAUCACTGGAGCAGACAUCAGGG | 2696-2718 | 1023 |
| AD-1571023.1 | GGCUCAGCAGCAAGAAUGCUU | 2853-2873 | 132 | AAGCAUUCUUGCUGCUGAGCCAC | 2851-2873 | 258 |
| AD-1571024.1 | UUGGGAUCUGGGAAUGGAAGU | 2983-3003 | 138 | ACUUCCAUUCCCAGAUCCCAAGU | 2981-3003 | 264 |
| AD-1571025.1 | CAGCUGCCCUUUGGAAUAAAU | 3164-3184 | 1684 | AUUUAUUCCAAAGGGCAGCUGAG | 3162-3184 | 1784 |
| AD-1571026.1 | CUGCCCUUUGGAAUAAAGCUU | 3167-3187 | 144 | AAGCTUTAUUCCAAAGGGCAGCU | 3165-3187 | 270 |
| AD-1571027.1 | GCCCUUUGGAAUAAAGCUGCU | 3169-3189 | 842 | AGCAGCUUUAUUCCAAAGGGCAG | 3167-3189 | 1785 |
| AD-1571028.1 | CCUCACCUGCUUCUUCUGGUU | 558-578 | 1685 | AACCAGAAGAAGCAGGUGAGGGG | 556-578 | 1786 |
| AD-1571029.1 | CCUCACCUGCUUCUUCUGGUU | 558-578 | 1685 | AACCAGAAGAAGCAGGUGAGGCU | 556-578 | 1787 |
| AD-1571030.1 | UCACCUGCUUCUUCUGGUU | 560-578 | 1686 | AACCAGAAGAAGCAGGUGAGG | 558-578 | 1788 |
| AD-1571031.1 | UCACCUGCUUCUUCUGGUU | 560-578 | 1686 | AACCAGAAGAAGCAGGUGACU | 558-578 | 1789 |
| AD-1571032.1 | ACCUGCUUCUUCUGGUU | 562-578 | 1687 | AACCAGAAGAAGCAGGUGA | 560-578 | 1790 |
| AD-1571033.1 | UCACCUGCUUCUUCUGGUU | 560-578 | 1686 | AACCAGAAGAAGCAGGUGA | 560-578 | 1790 |
| AD-1571034.1 | GGAGGUGAUGGCGAGGAAGCU | 190-210 | 1688 | AGCUUCUCGCCAUCACCUCCGU | 188-210 | 1791 |
| AD-1571035.1 | AAGGCCUGUGAGGACUCCAAU | 229-249 | 1689 | AUUGGAGUCCUCACAGGCCUUGA | 227-249 | 1792 |
| AD-1571036.1 | GGCCUGUGAGGACUCCAAGAU | 231-251 | 653 | AUCUUGGAGUCCUCACAGGCCUU | 229-251 | 1793 |
| AD-1571037.1 | GCCUGUGAGGACUCCAAGAGU | 232-252 | 20 | ACUCUGGAGUCCUCACAGGCCU | 230-252 | 146 |
| AD-1571038.1 | CUACUCUGGUAUUUCCUAGGU | 328-348 | 25 | ACCUAGGAAAUACCAGAGUAGCA | 326-348 | 151 |
| AD-1571039.1 | UCUGGUAUUUCCUAGGGUACU | 332-352 | 29 | AGUACCCUAGGAAAUACCAGAGU | 330-352 | 155 |
| AD-1571040.1 | CUGGUAUUUCCUAGGGUACAU | 333-353 | 1690 | AUGUACCCUAGGAAAUACCAGAG | 331-353 | 1794 |
| AD-1571041.1 | UGGUAUUUCCUAGGGUACAAU | 334-354 | 1691 | AUUGTACCCUAGGAAAUACCAGA | 332-354 | 1795 |
| AD-1571042.1 | CUAGGGUACAAGGCGGAGGUU | 343-363 | 662 | AACCUCCGCCUUGUACCCUAGGA | 341-363 | 1796 |
| AD-1571043.1 | AUGGUCAGCCAGGUGUACUCU | 364-384 | 663 | AGAGUACACCUGGCUGACCAUCA | 362-384 | 1797 |
| AD-1571044.1 | GUCAGCCAGGUGUACUCAGGU | 367-387 | 1692 | ACCUGAGUACACCUGGCUGACCA | 365-387 | 1798 |
| AD-1571045.1 | CAGCCAGGUGUACUCAGGCAU | 369-389 | 1693 | AUGCCUGAGUACACCUGGCUGAC | 367-389 | 1799 |
| AD-1571046.1 | CUCAAUCGCCACUUCUCCCAU | 400-420 | 667 | AUGGGAGAAGUGGCGAUUGAGUA | 398-420 | 1800 |
| AD-1571047.1 | CGCCACUUCUCCCAGGAUCUU | 406-426 | 668 | AAGATCCUGGGAGAAGUGGCGAU | 404-426 | 1801 |
| AD-1571048.1 | GCCACUUCUCCCAGGAUCUUU | 407-427 | 33 | AAAGAUCCUGGGAGAAGUGGCGA | 405-427 | 159 |
| AD-1571050.1 | UCCCAGGAUCUUACCCGCCGU | 415-435 | 35 | ACGGCGGGUAAGAUCCUGGGAGA | 413-435 | 161 |
| AD-1571051.1 | UAGUGCCUUCCGCAGUGAAAU | 441-461 | 1694 | AUUUCACUGCGGAAGGCACUAGA | 439-461 | 1802 |
| AD-1571052.1 | CUUCCGCAGUGAAACCGCCAU | 447-467 | 676 | AUGGCGGUUUCACUGCGGAAGGC | 445-467 | 1803 |
| AD-1571053.1 | CCGCAGUGAAACCGCCAAAGU | 450-470 | 677 | ACUUTGGCGGUUUCACUGCGGAA | 448-470 | 1804 |
| AD-1571054.1 | CGCAGUGAAACCGCCAAAGCU | 451-471 | 678 | AGCUUGGCGGUUUCACUGCGGA | 449-471 | 1805 |
| AD-1571055.1 | GCCAAAGCCCAGAAGAUGCUU | 463-483 | 683 | AAGCAUCUUCUGGGCUUUGGCGG | 461-483 | 880 |

TABLE 6-continued

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1571056.1 | CAGCACCCGCCUGGGAACUUU | 498-518 | 685 | AAAGTUCCCAGGCGGGUGCUGGU | 496-518 | 1806 |
| AD-1571057.1 | ACAACUCCAGCUCCGUCUAUU | 521-541 | 687 | AAUAGACGGAGCUGGAGUUGUAG | 519-541 | 884 |
| AD-1571058.1 | CACCUGCUUCUUCUGGUUCAU | 561-581 | 1695 | AUGAACCAGAAGAAGCAGGUGAG | 559-581 | 1807 |
| AD-1571059.1 | UGCUUCUUCUGGUUCAUUCUU | 565-585 | 43 | AAGAAUGAACCAGAAGAAGCAGG | 563-585 | 169 |
| AD-1571060.1 | UCUUCUGGUUCAUUCUCCAAU | 569-589 | 1696 | AUUGGAGAAUGAACCAGAAGAAG | 567-589 | 1808 |
| AD-1571061.1 | UUCUGGUUCAUUCUCCAAAUU | 571-591 | 1697 | AAUUGGAGAAUGAACCAGAAGA | 569-591 | 1809 |
| AD-1571062.1 | UCUGGUUCAUUCUCCAAAUCU | 572-592 | 1698 | AGAUUGGAGAAUGAACCAGAAG | 570-592 | 1810 |
| AD-1571063.1 | GUGGAGGAGCUGCUGUCCACU | 643-663 | 1699 | AGUGGACAGCAGCUCCUCCACCA | 641-663 | 1811 |
| AD-1571064.1 | GAGGAGCUGCUGUCCACAGUU | 646-666 | 1700 | AACUGUGGACAGCAGCUCCUCCA | 644-666 | 894 |
| AD-1571065.1 | AGCUGCUGUCCACAGUCAACU | 650-670 | 1701 | AGUUGACUGUGGACAGCAGCUCC | 648-670 | 895 |
| AD-1571066.1 | CUGUCCACAGUCAACAGCUCU | 655-675 | 1702 | AGAGCUGUUGACUGUGGACAGCA | 653-675 | 898 |
| AD-1571067.1 | ACAGGGCCGAGUACGAAGUGU | 689-709 | 48 | ACACUUCGUACUCGGCCCUGUAG | 687-709 | 1812 |
| AD-1571068.1 | GGGCCGAGUACGAAGUGGACU | 692-712 | 1703 | AGUCCACUUCGUACUCGGCCCUG | 690-712 | 1813 |
| AD-1571069.1 | UCCUGGAAGCCAGUGUGAAAU | 728-748 | 710 | AUUUCACACUGGCUUCCAGGAUC | 726-748 | 1814 |
| AD-1571070.1 | CUGGAAGCCAGUGUGAAAGAU | 730-750 | 712 | AUCUUUCACACUGGCUUCCAGGA | 728-750 | 1815 |
| AD-1571071.1 | AAGCCAGUGUGAAAGACAUAU | 734-754 | 716 | AUAUGUCUUUCACACUGGCUUCC | 732-754 | 1816 |
| AD-1571072.1 | GCCAGUGUGAAAGACAUAGCU | 736-756 | 718 | AGCUAUGUCUUUCACACUGGCUU | 734-756 | 1817 |
| AD-1571074.1 | UGUGAAAGACAUAGCUGCAUU | 741-761 | 721 | AAUGCAGCUAUGUCUUUCACACU | 739-761 | 916 |
| AD-1571075.1 | ACGCUGGGUUGUUACCGCUAU | 769-789 | 1704 | AUAGCGGUAACAACCCAGCGUGG | 767-789 | 1818 |
| AD-1571076.1 | CGCUGGGUUGUUACCGCUACU | 770-790 | 1705 | AGUAGCGGUAACAACCCAGCGUG | 768-790 | 919 |
| AD-1571077.1 | GCUGGGUUGUUACCGCUACAU | 771-791 | 1706 | AUGUAGCGGUAACAACCCAGCGU | 769-791 | 1819 |
| AD-1571078.1 | CUGGGUUGUUACCGCUACAGU | 772-792 | 59 | ACUGTAGCGGUAACAACCCAGCG | 770-792 | 185 |
| AD-1571079.1 | CUGGAGAAGAGGCUCAUCACU | 958-978 | 733 | AGUGAUGAGCCUCUUCUCCAGGG | 956-978 | 1820 |
| AD-1571080.1 | GAGAAGAGGCUCAUCACCUCU | 961-981 | 1707 | AGAGGUGAUGAGCCUCUUCUCCA | 959-981 | 930 |
| AD-1571081.1 | GAAGAGGCUCAUCACCUCGGU | 963-983 | 1708 | ACCGAGGUGAUGAGCCUCUUCUC | 961-983 | 931 |
| AD-1571082.1 | AGGCUCAUCACCUCGGUGUAU | 967-987 | 67 | AUACACCGAGGUGAUGAGCCUCU | 965-987 | 1821 |
| AD-1571083.1 | AAGAAGGGCCUGCACAGCUAU | 1054-1074 | 1709 | AUAGCUGUGCAGGCCCUUCUUCC | 1052-1074 | 1822 |
| AD-1571084.1 | AAGGGCCUGCACAGCUACUAU | 1057-1077 | 740 | AUAGUAGCUGUGCAGGCCCUUCU | 1055-1077 | 1823 |
| AD-1571085.1 | CCUCUCUGGACUACGGCUUGU | 1235-1255 | 70 | ACAAGCCGUAGUCCAGAGAGGGC | 1233-1255 | 1824 |
| AD-1571086.1 | UCUCUGGACUACGGCUUGGCU | 1237-1257 | 71 | AGCCAAGCCGUAGUCCAGAGAGG | 1235-1257 | 197 |
| AD-1571087.1 | UGGACUACGGCUUGGCCCUCU | 1241-1261 | 743 | AGAGGGCCAAGCCGUAGUCCAGA | 1239-1261 | 938 |
| AD-1571088.1 | GGACUACGGCUUGGCCCUCUU | 1242-1262 | 1710 | AAGAGGGCCAAGCCGUAGUCCAG | 1240-1262 | 939 |
| AD-1571089.1 | AGAAGUAUGAUUUGCCGUGCU | 1289-1309 | 83 | AGCACGGCAAAUCAUACUUCGC | 1287-1309 | 1825 |
| AD-1571090.1 | GAAGUAUGAUUUGCCGUGCAU | 1290-1310 | 84 | AUGCACGGCAAAUCAUACUUCUG | 1288-1310 | 1826 |
| AD-1571091.1 | AAGUAUGAUUUGCCGUGCACU | 1291-1311 | 1711 | AGUGCACGGCAAAUCAUACUUCU | 1289-1311 | 1827 |
| AD-1571092.1 | GUAUGAUUUGCCGUGCACCCU | 1293-1313 | 1712 | AGGGUGCACGGCAAAUCAUACUU | 1291-1313 | 1828 |
| AD-1571093.1 | GGCCAGUGGACGAUCCAGAAU | 1315-1335 | 751 | AUUCTGGAUCGUCCACUGGCCCU | 1313-1335 | 1829 |

TABLE 6-continued

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1571094.1 | GCCAGUGGACGAUCCAGAACU | 1316-1336 | 752 | AGUUCUGGAUCGUCCACUGGCCC | 1314-1336 | 945 |
| AD-1571096.1 | UGGACGAUCCAGAACAGGAGU | 1321-1341 | 755 | ACUCCUGUUCUGGAUCGUCCACU | 1319-1341 | 948 |
| AD-1571097.1 | CACCUCCCAGAUCUCCCUCAU | 1419-1439 | 757 | AUGAGGGAGAUCUGGGAGGUGAA | 1417-1439 | 1830 |
| AD-1571098.1 | UGCGGGUGCACUAUGGCUUGU | 1451-1471 | 759 | ACAAGCCAUAGUGCACCCGCACA | 1449-1471 | 1831 |
| AD-1571099.1 | GCGGGUGCACUAUGGCUUGUU | 1452-1472 | 91 | AACAAGCCAUAGUGCACCCGCAC | 1450-1472 | 217 |
| AD-1571100.1 | CGGGUGCACUAUGGCUUGUAU | 1453-1473 | 761 | AUACAAGCCAUAGUGCACCCGCA | 1451-1473 | 1832 |
| AD-1571102.1 | AACGGCCUGGAUGAGAGAAAU | 1561-1581 | 767 | AUUUCUCUCAUCCAGGCCGUUGG | 1559-1581 | 1833 |
| AD-1571103.1 | CGGCCUGGAUGAGAGAAACUU | 1563-1583 | 769 | AAGUUCUCUCAUCCAGGCCGUU | 1561-1583 | 1834 |
| AD-1571104.1 | GAGAAACUGCGUUUGCAGAGU | 1575-1595 | 772 | ACUCUGCAAACGCAGUUUCUCUC | 1573-1595 | 1835 |
| AD-1571105.1 | CUGCGUUUGCAGAGCCACAUU | 1581-1601 | 773 | AAUGUGGCUCUGCAAACGCAGUU | 1579-1601 | 1836 |
| AD-1571106.1 | UGCGUUUGCAGAGCCACAUUU | 1582-1602 | 774 | AAAUGUGGCUCUGCAAACGCAGU | 1580-1602 | 1837 |
| AD-1571107.1 | CGUUUGCAGAGCCACAUUCCU | 1584-1604 | 776 | AGGAAUGUGGCUCUGCAAACGCA | 1582-1604 | 1838 |
| AD-1571108.1 | GCAGAGCCACAUUCCAGUGCU | 1589-1609 | 777 | AGCACUGGAAUGUGGCUCUGCAA | 1587-1609 | 968 |
| AD-1571109.1 | GGGACAUUCACCUUCCAGUGU | 1711-1731 | 779 | ACACTGGAAGGUGAAUGUCCCAC | 1709-1731 | 1839 |
| AD-1571110.1 | GGACAUUCACCUUCCAGUGUU | 1712-1732 | 103 | AACACUGGAAGGUGAAUGUCCCA | 1710-1732 | 229 |
| AD-1571111.1 | ACAUUCACCUUCCAGUGUGAU | 1714-1734 | 105 | AUCACACUGGAAGGUGAAUGUCC | 1712-1734 | 1840 |
| AD-1571112.1 | AGCUGCGUGAAGAAGCCCAAU | 1741-1761 | 782 | AUUGGGCUUCUUCACGCAGCUCC | 1739-1761 | 1841 |
| AD-1571113.1 | GCUGCGUGAAGAAGCCCAACU | 1742-1762 | 783 | AGUUGGGCUUCUUCACGCAGCUC | 1740-1762 | 1842 |
| AD-1571114.1 | CUGCGUGAAGAAGCCCAACCU | 1743-1763 | 784 | AGGUGGGCUUCUUCACGCAGCU | 1741-1763 | 1843 |
| AD-1571115.1 | UGCGUGAAGAAGCCCAACCCU | 1744-1764 | 785 | AGGGUGGGCUUCUUCACGCAGC | 1742-1764 | 1844 |
| AD-1571116.1 | AGCACUGUGACUGUGGCUCUCU | 1808-1828 | 786 | AGAGGCCACAGUCACAGUGCUCC | 1806-1828 | 1845 |
| AD-1571117.1 | CUCCGAGGGUGAGUGGCCAUU | 1866-1886 | 787 | AAUGGCCACUCACCCUCGGAGGA | 1864-1886 | 976 |
| AD-1571118.1 | AUCGCUGACCGCUGGGUGAUU | 1936-1956 | 107 | AAUCACCCAGCGGUCAGCGAUGA | 1934-1956 | 233 |
| AD-1571119.1 | UCGCUGACCGCUGGGUGAUAU | 1937-1957 | 788 | AUAUCACCCAGCGGUCAGCGAUG | 1935-1957 | 1846 |
| AD-1571120.1 | GCUGACCGCUGGGUGAUAACU | 1939-1959 | 790 | AGUUAUCACCCAGCGGUCAGCGA | 1937-1959 | 980 |
| AD-1571121.1 | GCUGGGUGAUAACAGCUGCCU | 1946-1966 | 791 | AGGCAGCUGUUAUCACCCAGCGG | 1944-1966 | 981 |
| AD-1571122.1 | UGCUUCCAGGAGGACAGCAUU | 1969-1989 | 792 | AAUGCUGUCCUCCUGGAAGCAGU | 1967-1989 | 1847 |
| AD-1571123.1 | CUUCCAGGAGGACAGCAUGGU | 1971-1991 | 794 | ACCAUGCUGUCCUCCUGGAAGCA | 1969-1991 | 1848 |
| AD-1571124.1 | CUGGGCAAGGUGUGGCAGAAU | 2017-2037 | 1713 | AUUCUGCCACACCUUGCCCAGGA | 2015-2037 | 1849 |
| AD-1571125.1 | UGGGCAAGGUGUGGCAGAACU | 2018-2038 | 797 | AGUUCUGCCACACCUUGCCCAGG | 2016-2038 | 986 |
| AD-1571126.1 | GGCAAGGUGUGGCAGAACUCU | 2020-2040 | 799 | AGAGUUCUGCCACACCUUGCCCA | 2018-2040 | 1850 |
| AD-1571127.1 | UGGCCUGGAGAGGUGUCCUUU | 2044-2064 | 802 | AAAGGACACCUCUCCAGGCCAGC | 2042-2064 | 990 |
| AD-1571128.1 | GCCUGGAGAGGUGUCCUUCAU | 2046-2066 | 804 | AUGAAGGACACCUCUCCAGGCCA | 2044-2066 | 1851 |
| AD-1571129.1 | CCUGGAGAGGUGUCCUUCAAU | 2047-2067 | 1714 | AUUGAAGGACACCUCUCCAGGCC | 2045-2067 | 1852 |
| AD-1571130.1 | UGUGCAGUUGAUCCCACAGGU | 2289-2309 | 1715 | ACCUGUGGGAUCAACUGCACAUC | 2287-2309 | 994 |
| AD-1571131.1 | UGCAGUUGAUCCCACAGGACU | 2291-2311 | 808 | AGUCCUGUGGGAUCAACUGCACA | 2289-2311 | 995 |
| AD-1571132.1 | AUCCCACAGGACCUGUGCAGU | 2299-2319 | 117 | ACUGCACAGGUCCUGUGGGAUCA | 2297-2319 | 243 |

TABLE 6-continued

Unmofidied Sense and Antisense Strand Sequences of TMPRSS6 dsRNA Agents

| Duplex Name | Sense Strand Sequence 5' to 3' | Range in NM_153609.4 | SEQ ID NO: | Antisense Strand Sequence 5' to 3' | Range in NM_153609.4 | SEQ ID NO: |
|---|---|---|---|---|---|---|
| AD-1571133.1 | CCCACAGGACCUGUGCAGCGU | 2301-2321 | 809 | ACGCTGCACAGGUCCUGUGGGAU | 2299-2321 | 1853 |
| AD-1571134.1 | CCACAGGACCUGUGCAGCGAU | 2302-2322 | 1716 | AUCGCUGCACAGGUCCUGUGGGA | 2300-2322 | 1854 |
| AD-1571135.1 | CCAGGUGACGCCACGCAUGCU | 2334-2354 | 811 | AGCATGCGUGGCGUCACCUGGUA | 2332-2354 | 1855 |
| AD-1571136.1 | GUGACGCCACGCAUGCUGUGU | 2338-2358 | 812 | ACACAGCAUGCGUGGCGUCACCU | 2336-2358 | 1000 |
| AD-1571137.1 | UGACGCCACGCAUGCUGUGUU | 2339-2359 | 118 | AACACAGCAUGCGUGGCGUCACC | 2337-2359 | 244 |
| AD-1571138.1 | ACGCCACGCAUGCUGUGUGCU | 2341-2361 | 1717 | AGCACACAGCAUGCGUGGCGUCA | 2339-2361 | 1856 |
| AD-1571139.1 | GGCUACCGCAAGGGCAAGAAU | 2362-2382 | 814 | AUUCUUGCCCUUGCGGUAGCCGG | 2360-2382 | 1857 |
| AD-1571140.1 | GUGCAAGGCACUCAGUGGCCU | 2418-2438 | 815 | AGGCCACUGAGUGCCUUGCACAC | 2416-2438 | 1858 |
| AD-1571141.1 | CUAACUACUUCGGCGUCUACU | 2486-2506 | 1718 | AGUAGACGCCGAAGUAGUUAGGC | 2484-2506 | 1006 |
| AD-1571142.1 | CUACACCCGCAUCACAGGUGU | 2502-2522 | 124 | ACACCUGUGAUGCGGGUGUAGAC | 2500-2522 | 250 |
| AD-1571143.1 | CCCGCAUCACAGGUGUGAUCU | 2507-2527 | 822 | AGAUCACACCUGUGAUGCGGGUG | 2505-2527 | 1012 |
| AD-1571144.1 | UGGAUCCAGCAAGUGGUGACU | 2530-2550 | 823 | AGUCACCACUUGCUGGAUCCAGC | 2528-2550 | 1859 |
| AD-1571145.1 | AUCCAGCAAGUGGUGACCUGU | 2533-2553 | 1719 | ACAGGUCACCACUUGCUGGAUCC | 2531-2553 | 1860 |
| AD-1571146.1 | CCAGCAAGUGGUGACCUGAGU | 2535-2555 | 1720 | ACUCAGGUCACCACUUGCUGGAU | 2533-2555 | 1016 |
| AD-1571147.1 | CAGCAAGUGGUGACCUGAGGU | 2536-2556 | 1721 | ACCUCAGGUCACCACUUGCUGGA | 2534-2556 | 1017 |
| AD-1571148.1 | GCAAGUGGUGACCUGAGGAAU | 2538-2558 | 1722 | AUUCCUCAGGUCACCACUUGCUG | 2536-2558 | 1861 |
| AD-1571149.1 | UGGUGGCAGGAGGUGGCAUCU | 2667-2687 | 829 | AGAUGCCACCUCCUGCCACCACA | 2665-2687 | 1862 |
| AD-1571150.1 | GGUGGCAGGAGGUGGCAUCUU | 2668-2688 | 830 | AAGATGCCACCUCCUGCCACCAC | 2666-2688 | 1863 |
| AD-1571151.1 | GUGGCAGGAGGUGGCAUCUUU | 2669-2689 | 831 | AAAGAUGCCACCUCCUGCCACCA | 2667-2689 | 1021 |
| AD-1571152.1 | UCCAGUGAUGGCAGGAGGAUU | 2709-2729 | 1723 | AAUCCUCCUGCCAUCACUGGAGC | 2707-2729 | 1864 |
| AD-1571153.1 | CUAACUUGGGAUCUGGGAAUU | 2978-2998 | 835 | AAUUCCCAGAUCCCAAGUUAGAC | 2976-2998 | 1025 |
| AD-1571154.1 | GUGAGCUCAGCUGCCCUUUGU | 3157-3177 | 837 | ACAAAGGGCAGCUGAGCUCACCU | 3155-3177 | 1026 |
| AD-1571155.1 | CUCAGCUGCCCUUUGGAAUAU | 3162-3182 | 838 | AUAUUCCAAAGGGCAGCUGAGCU | 3160-3182 | 1865 |
| AD-1571156.1 | UCAGCUGCCCUUUGGAAUAAU | 3163-3183 | 1724 | AUUAUUCCAAAGGGCAGCUGAGC | 3161-3183 | 1866 |
| AD-1571157.1 | CCCUUUGGAAUAAAGCUGCCU | 3170-3190 | 1725 | AGGCAGCUUUAUUCCAAAGGGCA | 3168-3190 | 1867 |
| AD-1571158.1 | CCUUUGGAAUAAAGCUGCCUU | 3171-3191 | 844 | AAGGCAGCUUUAUUCCAAAGGGC | 3169-3191 | 1868 |
| AD-1571159.1 | UUUGGAAUAAAGCUGCCUGAU | 3173-3193 | 845 | AUCAGGCAGCUUUAUUCCAAAGG | 3171-3193 | 1869 |
| AD-1571160.1 | UUGGAAUAAAGCUGCCUGAUU | 3174-3194 | 846 | AAUCAGGCAGCUUUAUUCCAAAG | 3172-3194 | 1870 |
| AD-1571161.1 | UGGAAUAAAGCUGCCUGAUCU | 3175-3195 | 847 | AGAUCAGGCAGCUUUAUUCCAAA | 3173-3195 | 1871 |

TABLE 7

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1570929.1 | csgsgaggUfgAfUfGfgcgaggaaguL96 | 1872 | asCfsuudCc(Tgn)cgccauCfaCfcuccgsusc | 2099 | GACGGAGGUGAUGGCGAGGAGC | 1491 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1570930.1 | cscsugugAfgGfAfCfuccaagagauL96 | 1873 | asUfscudCu(Tgn)ggagucCfuCfacaggscsc | 2100 | GGCCUGUGAGGACUCCAAGAGAA | 1495 |
| AD-1570931.1 | csusgugaGfgAfCfUfccaagagaauL96 | 1874 | asUfsucdTc(Tgn)uggaguCfcUfcacagsgsc | 2101 | GCCUGUGAGGACUCCAAGAGAA | 1496 |
| AD-1570932.1 | csuscuggUfaUfUfUfccuagggauL96 | 1875 | asUfsacdCc(Tgn)aggaaaUfaCfcagagsusa | 2102 | UACUCUGGUAUUUCCUAGGGUAC | 532 |
| AD-1570933.1 | gsgsuauuUfcCfUfAfggguacaaguL96 | 1876 | asCfsuudGu(Agn)cccuagGfaAfauaccsasg | 2103 | CUGGUAUUUCCUAGGGUACAAGG | 1499 |
| AD-1570934.1 | gsusauuuCfcUfUfAfGfgguacaagguL96 | 1877 | asCfscudTg(Tgn)acccuaGfgAfaauacscsa | 2104 | UGGUAUUUCCUAGGGUACAAGGC | 1500 |
| AD-1570935.1 | gsgsucagCfcAfGfGfuguacucaguL96 | 1878 | asCfsugdAg(Tgn)acaccuGfgCfugaccsasu | 2105 | AUGGUCAGCCAGGUGUACUCAGG | 535 |
| AD-1570936.1 | ucsagccAfgGfUfGfuacucaggcuL96 | 1879 | asGfsccdTg(Agn)guacacCfuGfgcugascsc | 2106 | GGUCAGCCAGGUGUACUCAGGCA | 1504 |
| AD-1570937.1 | asgsccagGfuGfUfAfcucaggcaguL96 | 1880 | asCfsugdCc(Tgn)gaguacAfcCfuggcusgsa | 2107 | UCAGCCAGGUGUACUCAGGCAGU | 536 |
| AD-1570938.1 | csascuucUfcCfCfAfggaucuuacuL96 | 1881 | asGfsuadAg(Agn)uccuggGfaGfaagugsgsc | 2108 | GCCACUUCUCCCAGGAUCUUACC | 1508 |
| AD-1570939.1 | uscsucccAfgGfAfUfcuuacccgcuL96 | 1882 | asGfscgdGg(Tgn)aagaucCfuGfggagasasg | 2109 | CUUCUCCCAGGAUCUUACCCGCC | 1509 |
| AD-1570940.1 | gscscuucCfgCfAfGfugaaaccgcuL96 | 1883 | asGfscgdGu(Tgn)ucacugCfgGfaaggcsasc | 2110 | GUGCCUUCCGCAGUGAAACCGCC | 540 |
| AD-1570941.1 | cscsuuccGfcAfGfUfgaaaccgccuL96 | 1884 | asGfsgcdGg(Tgn)uucacuGfcGfgaaggscsa | 2111 | UGCCUUCCGCAGUGAAACCGCCA | 1512 |
| AD-1570942.1 | gscsagugAfaAfCfCfgccaaagccuL96 | 1885 | asGfsgcdTu(Tgn)ggcgguUfuCfacugcsgsg | 2112 | CCGCAGUGAAACCGCCAAAGCCC | 1516 |
| AD-1570943.1 | csasgugaAfaCfCfGfccaaagcccuL96 | 1886 | asGfsggdCu(Tgn)uggcggUfuUfcacugscsg | 2113 | CGCAGUGAAACCGCCAAAGCCCA | 1517 |
| AD-1570944.1 | asgsugaaAfcCfGfCfcaaagcccauL96 | 1887 | asUfsggdGc(Tgn)uugcgGfuUfucacusgscs | 2114 | GCAGUGAAACCGCCAAAGCCCAG | 1518 |
| AD-1570945.1 | csgsccaaAfgCfCfCfagaagaugcuL96 | 1888 | asGfscadTc(Tgn)ucugggCfuUfuggcgsgsu | 2115 | ACCGCAAAGCCCAGAAGAUGCU | 1519 |
| AD-1570946.1 | asgscccaGfaAfAfGfAfugcucaagguL96 | 1889 | asCfscudTg(Agn)gcaucuUfcUfgggcususu | 2116 | AAAGCCCAGAAGAUGCUCAAGGA | 1521 |
| AD-1570947.1 | asgscaccCfgCfCfCfugggaacuuauL96 | 1890 | asUfsaadGu(Tgn)cccaggCfgGfgugcusgsg | 2117 | CCAGCACCCGCCUGGGAACUUAC | 1523 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1570948.1 | csasacucCfaGfCfUfccgucuauuuL96 | 1891 | asAfsaudAg(Agn)cggagcUfgGfaguugsusa | 2118 | UACAACUCCAGCUCCGUCUAUUC | 541 |
| AD-1570949.1 | uscsaccuGfcUfUfCfuucugguucuL96 | 1892 | asGfsaadCc(Agn)gaagaaGfcAfggugasgsg | 2119 | CCUCACCUGCUUCUUCUGGUUCA | 544 |
| AD-1570950.1 | cscsugcuUfcUfUfCfugguucauuuL96 | 1893 | asAfsaudGa(Agn)ccagaaGfaAfgcaggsusg | 2120 | CACCUGCUUCUUCUGGUUCAUUC | 546 |
| AD-1570951.1 | csusgcuuCfuUfCfUfUfgguucauucuL96 | 1894 | asGfsaadTg(Agn)accagaAfgAfagcagsgsu | 2121 | ACCUGCUUCUUCUGGUUCAUUCU | 1526 |
| AD-1570952.1 | csusucuuCfuGfGfUfucauucuccuL96 | 1895 | asGfsgadGa(Agn)ugaaccAfgAfagaagscsa | 2122 | UGCUUCUUCUGGUUCAUUCUCCA | 549 |
| AD-1570953.1 | ususcuucUfgGfUfUfUfcauucuccauL96 | 1896 | asUfsggdAg(Agn)augaacCfaGfaagaasgsc | 2123 | GCUUCUUCUGGUUCAUUCUCCAA | 550 |
| AD-1570954.1 | csusucugGfuUfUfCfAfuucuccaaauL96 | 1897 | asUfsuudGg(Agn)gaaugaAfcCfagaagsasa | 2124 | UUCUUCUGGUUCAUUCUCCAAAU | 1528 |
| AD-1570955.1 | csusgguuCfaUfUfCfuccaaauccuL96 | 1898 | asGfsgadTu(Tgn)ggagaaUfgAfaccagsasa | 2125 | UUCUGGUUCAUUCUCCAAAUCC | 551 |
| AD-1570956.1 | gscsugcuGfuCfCfAfcagucaacauL96 | 1899 | asUfsgudTg(Agn)cugggAfcAfgcagcsusc | 2126 | GAGCUGCUGUCCACAGUCAACAG | 1534 |
| AD-1570957.1 | gscsugucCfaCfAfGfucaacagcuuL96 | 1900 | asAfsgcdTg(Tgn)ugacugUfgGfacagcsasg | 2127 | CUGCUGUCCACAGUCAACAGCUC | 1535 |
| AD-1570958.1 | usgsuccaCfaGfUfCfaacagcucguL96 | 1901 | asCfsgadGc(Tgn)guugacUfgUfggacasgsc | 2128 | GCUGUCCACAGUCAACAGCUCGG | 1537 |
| AD-1570959.1 | gsgsccgaGfuAfCfGfaaguggaccuL96 | 1902 | asGfsgudCc(Agn)cuucguAfcUfcggccscsu | 2129 | AGGGCCGAGUACGAAGUGGACCC | 1539 |
| AD-1570960.1 | asusccugGfaAfGfCfcagugugaauL96 | 1903 | asUfsucdAc(Agn)cugcuUfcCfaggauscsa | 2130 | UGAUCCUGGAAGCCAGUGUGAAA | 1540 |
| AD-1570961.1 | cscsuggaAfgCfCfAfgugugaaaguL96 | 1904 | asCfsuudTc(Agn)cacuggCfuUfccaggsasu | 2131 | AUCCUGGAAGCCAGUGUGAAAGA | 1542 |
| AD-1570962.1 | usgsgaagCfcAfGfUfgugaaagacuL96 | 1905 | asGfsucdTu(Tgn)cacacuGfcUfuuccasgsg | 2132 | CCUGGAAGCCAGUGUGAAAGACA | 1544 |
| AD-1570963.1 | gsgsaagcCfaGfUfGfugaaagacauL96 | 1906 | asUfsgudCu(Tgn)ucacacUfgGfcuuccsasg | 2133 | CUGGAAGCCAGUGUGAAAGACAU | 1545 |
| AD-1570964.1 | gsasagccAfgUfGfUfgaaagacauuL96 | 1907 | asAfsugdTc(Tgn)uucacaCfuGfgcuucscsa | 2134 | UGGAAGCCAGUGUGAAAGACAUA | 1546 |
| AD-1570965.1 | asgsccagUfgUfGfAfaagacauaguL96 | 1908 | asCfsuadTg(Tgn)cuuucaCfaCfuggcususcs | 2135 | GAAGCCAGUGUGAAAGACAUAGC | 1548 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1570966.1 | cscsagugUfgAfAf AfgacauagcuuL96 | 1909 | asAfsgcdTa(Tgn)guc uuuCfaCfacuggscsu | 2136 | AGCCAGUGUGA AAGACAUAG CUG | 554 |
| AD-1570967.1 | asgsugugAfaAfGf AfcauagcugcuL96 | 1910 | asGfscadGc(Tgn)aug ucuUfuCfacacusgsg | 2137 | CCAGUGUGAAA GACAUAGCU GCA | 1550 |
| AD-1570968.1 | gsusgaaaGfaCfAf UfagcugcauuuL96 | 1911 | asAfsaudGc(Agn)gcu augUfcUfuucacsasc | 2138 | GUGUGAAAGAC AUAGCUGCA UUG | 1553 |
| AD-1570969.1 | asusugaaUfuCfCf AfcgcugggiuuuL96 | 1912 | asAfsacdCc(Agn)gcg uggAfaUfucaausgsc | 2139 | GCAUUGAAUUC CACGCUGGGU UG | 556 |
| AD-1570970.1 | asasuuccAfcGfCf UfggguuguuauL96 | 1913 | asUfsaadCa(Agn)ccc agcGfuGfgaauuscsa | 2140 | UGAAUUCCACG CUGGGUUGU UAC | 559 |
| AD-1570971.1 | csascgcuGfgGfUf UfguuaccgcuuL96 | 1914 | asAfsgcdGg(Tgn)aac aacCfcAfgcgugsgsa | 2141 | UCCACGCUGGG UUGUUACCGC UA | 562 |
| AD-1570972.1 | usgsgguuGfuUfAf CfcgcuacagcuL96 | 1915 | asGfscudGu(Agn)gcg guaAfcAfacccasgsc | 2142 | GCUGGGUUGUU ACCGCUACAG CU | 1557 |
| AD-1570973.1 | gsgsguugUfuAfCf CfgcuacagcuuL96 | 1916 | asAfsgcdTg(Tgn)agc gguAfaCfaacccsasg | 2143 | CUGGGUUGUUA CCGCUACAGC UA | 1558 |
| AD-1570974.1 | csasaacuCfcGfGf CfuggaguggauL96 | 1917 | asUfsccdAc(Tgn)cca gccGfgAfguuugsasg | 2144 | CUCAAACUCCG GCUGGAGUGG AC | 1559 |
| AD-1570975.1 | gsgsgaccGfaCfUf GfgccauguauuL96 | 1918 | asAfsuadCa(Tgn)ggc cagUfcGfgucccsgsg | 2145 | CCGGGACCGAC UGGCCAUGUA UG | 564 |
| AD-1570976.1 | csgsacugGfcCfAf UfguaugacguuL96 | 1919 | asAfscgdTc(Agn)uac augGfcCfagucgsgsu | 2146 | ACCGACUGGCC AUGUAUGACG UG | 1560 |
| AD-1570977.1 | usgsgagaAfgAfGf GfcucaucaccuL96 | 1920 | asGfsgudGa(Tgn)gag ccuCfuUfccasgsg | 2147 | CCUGGAGAAGA GGCUCAUCAC CU | 1562 |
| AD-1570978.1 | gsgsagaaGfaGfGf CfucaucaccuuL96 | 1921 | asAfsggdTg(Agn)uga gccUfcUfucuccsasg | 2148 | CUGGAGAAGAG GCUCAUCACC UC | 1563 |
| AD-1570979.1 | gsasagaaGfgGfCf CfugcacagcuuL96 | 1922 | asAfsgcdTg(Tgn)gca ggcCfcUfucuucscsa | 2149 | UGGAAGAAGGG CCUGCACAGC UA | 1566 |
| AD-1570980.1 | asgsggccUfgCfAf CfagcuacuacuL96 | 1923 | asGfsuadGu(Agn)gcu gugCfaGfgcccusgsc | 2150 | GAAGGGCCUGC ACAGCUACUA CG | 1569 |
| AD-1570981.1 | cscsugcaCfaGfCf UfacuacgaccuL96 | 1924 | asGfsgudCg(Tgn)agu agcUfgUfgcaggscsc | 2151 | GGCCUGCACAG CUACUACGAC CC | 573 |
| AD-1570982.1 | gsasggagGfcAfGf AfaguaugauuuL96 | 1925 | asAfsaudCa(Tgn)acu ucuGfcCfuccucsasg | 2152 | CUGAGGAGGCA GAAGUAUGA UUU | 580 |
| AD-1570983.1 | asgsgaggCfaGfAf AfguaugauuuL96 | 1926 | asAfsaadTc(Agn)uac uucUfgCfcuccuscsa | 2153 | UGAGGAGGCAG AAGUAUGAU UUG | 1572 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1570984.1 | asgsuaugAfuUfUf GfccgugcaccuL96 | 1927 | asGfsgudGc(Agn)cgg caaAfuCfauacususc | 2154 | GAAGUAUGAUU UGCCGUGCA CCC | 1574 |
| AD-1570985.1 | cscsagugGfaCfGf AfuccagaacauL96 | 1928 | asUfsgudTc(Tgn)gga ucgUfcCfacuggscsc | 2155 | GGCCAGUGGAC GAUCCAGAAC AG | 1578 |
| AD-1570986.1 | cscsagaaCfaGfGf AfggcuguguguL96 | 1929 | asCfsacdAc(Agn)gcc uccUfgUfucuggsasu | 2156 | AUCCAGAACAG GAGGCUGUG UGG | 591 |
| AD-1570987.1 | asgsaacaGfgAfGf GfcuguguggcuL96 | 1930 | asGfsccdAc(Agn)cag ccuCfcUfguucusgsg | 2157 | CCAGAACAGGA GGCUGUGUG GCU | 592 |
| AD-1570988.1 | ascsuucaCfcUfCf CfcagaucuccuL96 | 1931 | asGfsgadGa(Tgn)cug ggaGfgUfgaagususg | 2158 | CAACUUCACCU CCCAGAUCUC CC | 1580 |
| AD-1570989.1 | usgsugcgGfgUfGf CfacuauggcuuL96 | 1932 | asAfsgcdCa(Tgn)agu gcaCfcCfgcacascsc | 2159 | GGUGUGCGGGU GCACUAUGG CUU | 593 |
| AD-1570990.1 | gsusgcggGfuGfCf AfcuauggcuuuL96 | 1933 | asAfsagdCc(Agn)uag ugcAfcCfcgcacsasc | 2160 | GUGUGCGGGUG CACUAUGGC UUG | 594 |
| AD-1570991.1 | gsgsgugcAfcUfAf UfggcuuguacuL96 | 1934 | asGfsuadCa(Agn)gcc auaGfuGfcacccsgsc | 2161 | GCGGGUGCACU AUGGCUUGU ACA | 596 |
| AD-1570992.1 | gsgsugcaCfuAfUf GfgcuuguacauL96 | 1935 | asUfsgudAc(Agn)agc cauAfgUfgcaccscsg | 2162 | CGGGUGCACUA UGGCUUGUAC AA | 1584 |
| AD-1570993.1 | usgscacuAfuGfGf CfuuguacaacuL96 | 1936 | asGfsuudGu(Agn)caa gccAfuAfgugcascsc | 2163 | GGUGCACUAUG GCUUGUACA ACC | 1585 |
| AD-1570994.1 | gscsacuaUfgGfCf UfuguacaaccuL96 | 1937 | asGfsgudTg(Tgn)aca agcCfaUfagugcsasc | 2164 | GUGCACUAUGG CUUGUACAAC CA | 1586 |
| AD-1570995.1 | csusgcccUfgGfAf GfaguuccucuuL96 | 1938 | asAfsgadGg(Agn)acu cucCfaGfggcagsgsg | 2165 | CCCUGCCCUGG AGAGUUCCUC UG | 599 |
| AD-1570996.1 | ascsggccUfgGfAf UfgagagaaacuL96 | 1939 | asGfsuudTc(Tgn)cuc aucCfaGfgccgususg | 2166 | CAACGGCCUGG AUGAGAGAA ACU | 1589 |
| AD-1570997.1 | gscscuggAfuGfAf GfagaaacugcuL96 | 1940 | asGfscadGu(Tgn)ucu cucAfuCfcaggcscsg | 2167 | CGGCCUGGAUG AGAGAAACU GCG | 600 |
| AD-1570998.1 | cscsuggaUfgAfGf AfgaaacugcguL96 | 1941 | asCfsgcdAg(Tgn)uuc ucuCfaUfccaggscsc | 2168 | GGCCUGGAUGA GAGAAACUG CGU | 1591 |
| AD-1570999.1 | asgsagaaAfcUfGf CfguuugcagauL96 | 1942 | asUfscudGc(Agn)aac gcaGfuUfucucuscsa | 2169 | UGAGAAACU GCGUUUGCA GAG | 1592 |
| AD-1571000.1 | gscsguuuGfcAfGf AfgccacauucuL96 | 1943 | asGfsaadTg(Tgn)ggc ucuGfcAfaacgcsasg | 2170 | CUGCGUUUGCA GAGCCACAUU CC | 1596 |
| AD-1571001.1 | usgsggacAfuUfCf AfccuuccaguuL96 | 1944 | asAfscudGg(Agn)agg ugaAfuGfucccascsa | 2171 | UGUGGGACAUU CACCUUCCAG UG | 606 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571002.1 | gsasgcugCfgUfGf Afagaagcccau L96 | 1945 | asUfsggdGc(Tgn)ucu ucaCfgCfagcucscsg | 2172 | CGGAGCUGCGU GAAGAAGCCC AA | 1600 |
| AD-1571003.1 | csgscugaCfcGfCf Ufgggugauaau L96 | 1946 | asUfsuadTc(Agn)ccc agcGfgUfcagcgsasu | 2173 | AUCGCUGACCG CUGGGUGAUA AC | 1608 |
| AD-1571004.1 | gscsuuccAfgGfAf Gfgacagcaugu L96 | 1947 | asCfsaudGc(Tgn)guc cucCfuGfgaagcsasg | 2174 | CUGCUUCCAGG AGGACAGCAU GG | 1612 |
| AD-1571005.1 | csgsuguuCfcUfGf Gfgcaagguguu L96 | 1948 | asAfscadCc(Tgn)ugc ccaGfgAfacacgsgsu | 2175 | ACCGUGUUCCU GGGCAAGGUG UG | 613 |
| AD-1571006.1 | gsgsgcaaGfgUfGf Ufggcagaacuu L96 | 1949 | asAfsgudTc(Tgn)gcc acaCfcUfugcccsasg | 2176 | CUGGGCAAGGU GUGGCAGAA CUC | 1616 |
| AD-1571007.1 | gscsaaggUfgUfGf Gfcagaacucgu L96 | 1950 | asCfsgadGu(Tgn)cug ccaCfaCfcuugcscsc | 2177 | GGGCAAGGUGU GGCAGAACU CGC | 615 |
| AD-1571008.1 | csasagguGfuGfGf Cfagaacucgcu L96 | 1951 | asGfscgdAg(Tgn)ucu gccAfcAfccuugscsc | 2178 | GGCAAGGUGUG GCAGAACUC GCG | 1618 |
| AD-1571009.1 | gsgsccugGfaGfAf Gfguguccuucu L96 | 1952 | asGfsaadGg(Agn)cac cucUfcCfaggccsasg | 2179 | CUGGCCUGGAG AGGUGUCCUU CA | 1620 |
| AD-1571010.1 | csusggagAfgGfUf Gfuccuucaagu L96 | 1953 | asCfsuudGa(Agn)gga cacCfuCfuccagsgsc | 2180 | GCCUGGAGAGG UGUCCUUCAA GG | 617 |
| AD-1571011.1 | asgsagguGfuCfCf Ufucaaggugau L96 | 1954 | asUfscadCc(Tgn)uga aggAfcAfccucuscsc | 2181 | GGAGAGGUGUC CUUCAAGGU GAG | 620 |
| AD-1571012.1 | gscsuaccGfcAfAf Gfggcaagaagu L96 | 1955 | asCfsuudCu(Tgn)gcc cuuGfcGfguagcscsg | 2182 | CGGCUACCGCA AGGGCAAGAA GG | 624 |
| AD-1571013.1 | csusaccgCfaAfGf Gfgcaagaaggu L96 | 1956 | asCfscudTc(Tgn)ugc ccuUfgCfgguagscsc | 2183 | GGCUACCGCAA GGGCAAGAAG GA | 625 |
| AD-1571014.1 | ascsuacuUfcGfGf Cfgcuacaccu L96 | 1957 | asGfsgudGu(Agn)gac gccGfaAfguagususa | 2184 | UAACUACUUCG GCGUCUACAC CC | 1633 |
| AD-1571015.1 | csusacuuCfgGfCf Gfucuacaccu L96 | 1958 | asGfsggdTg(Tgn)aga cgcCfgAfaguagsusu | 2185 | AACUACUUCGG CGUCUACACC CG | 1634 |
| AD-1571016.1 | gscsgucuAfcAfCf Cfcgcaucacau L96 | 1959 | asUfsgudGa(Tgn)gcg gguGfuAfgacgcscsg | 2186 | CGGCGUCUACA CCCGCAUCAC AG | 1635 |
| AD-1571017.1 | csgsucuaCfaCfCf Cfgcaucacagu L96 | 1960 | asCfsugdTg(Agn)ugc gggUfgUfagacgscsc | 2187 | GGCGUCUACAC CCGCAUCACA GG | 1636 |
| AD-1571018.1 | ascsccgcAfuCfAf Cfaggugugauu L96 | 1961 | asAfsucdAc(Agn)ccu gugAfuUfcgggusgsu | 2188 | ACACCCGCAUC ACAGGUGUGA UC | 1637 |
| AD-1571019.1 | gsasuccaGfcAfAf Gfuggugaccuu L96 | 1962 | asAfsggdTc(Agn)cca cuuGfcUfggaucscsa | 2189 | UGGAUCCAGCA AGUGGUGACC UG | 1640 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
| --- | --- | --- | --- | --- | --- | --- |
| AD-1571020.1 | gsgscaggAfgGfUf GfgcaucuuguuL96 | 1963 | asAfscadAg(Agn)ugc cacCfuCfcugccsasc | 2190 | GUGGCAGGAGG UGGCAUCUU GUC | 631 |
| AD-1571021.1 | uscsccugAfuGfUf CfugcuccaguuL96 | 1964 | asAfscudGg(Agn)gca gacAfuCfagggascsg | 2191 | CGUCCCUGAUG UCUGCUCCAG UG | 1648 |
| AD-1571022.1 | csusgaugUfcUfGf CfuccagugauuL96 | 1965 | asAfsucdAc(Tgn)gga gcaGfaCfaucagsgsg | 2192 | CCCUGAUGUCU GCUCCAGUGA UG | 1649 |
| AD-1571023.1 | gsgscucaGfcAfGf CfaagaaugcuuL96 | 1966 | asAfsgcdAu(Tgn)cuu gcuGfcUfgagccsasc | 2193 | GUGGCUCAGCA GCAAGAAUGC UG | 636 |
| AD-1571024.1 | ususgggaUfcUfGf GfgaauggaaguL96 | 1967 | asCfsuudCc(Agn)uuc ccaGfaUfcccaasgsu | 2194 | ACUUGGGAUCU GGGAAUGGA AGG | 642 |
| AD-1571025.1 | csasgcugCfcCfUf UfuggaauaaauL96 | 1968 | asUfsuudAu(Tgn)cca aagGfgCfagcugsasg | 2195 | CUCAGCUGCCC UUUGGAAUAA AG | 1655 |
| AD-1571026.1 | csusgcccUfuUfGf GfaauaaagcuuL96 | 1969 | asAfsgcdTu(Tgn)auu ccaAfaGfggcagscsu | 2196 | AGCUGCCCUUU GGAAUAAAGC UG | 648 |
| AD-1571027.1 | gscsccuuUfgGfAf AfuaaagcugcuL96 | 1970 | asGfscadGc(Tgn)uua uucCfaAfagggcsasg | 2197 | CUGCCCUUUGG AAUAAAGCUG CC | 1656 |
| AD-1571028.1 | cscsucacCfuGfCf UfucuucgguuL96 | 1971 | asAfsccaGfaAfGfaag cAfgGfugaggsgsg | 2198 | CCCCUCACCUG CUUCUUCUGG uu | 2328 |
| AD-1571029.1 | cscsucacCfuGfCf UfucuucgguuL96 | 1971 | asAfsccaGfaAfGfaag cAfgGfugaggscsu | 2199 | CCCCUCACCUG CUUCUUCUGG UU | 2328 |
| AD-1571030.1 | uscsacCfuGfCfUf ucuucgguuL96 | 1972 | asAfsccaGfaAfGfaag cAfgGfugasgsg | 2200 | CCUCACCUGCU UCUUCUGGUU | 2329 |
| AD-1571031.1 | uscsacCfuGfCfUf ucuucgguuL96 | 1972 | asAfsccaGfaAfGfaag cAfgGfugascsu | 2201 | CCUCACCUGCU UCUUCUGGUU | 2329 |
| AD-1571032.1 | ascsCfuGfCfUfuc uucgguuL96 | 1973 | asAfsccaGfaAfGfaag cAfgGfusgsa | 2202 | UCACCUGCUUC UUCUGGUU | 2330 |
| AD-1571033.1 | Q191sUfcAfcCfuG fcUfuCfuUfcUfg GfsusUf | 2332 | asAfscCfaGfaAfgGfa GfcAfgGfusGfsa | 2203 | UCACCUGCUUC UUCUGGUU | 2330 |
| AD-1571034.1 | gsgsagguGfaUfGf GfcgaggaagcuL96 | 1975 | asGfscudTc(C2p)ucg ccaUfcAfccucsgsu | 2204 | ACGGAGGUGAU GGCGAGGAA GCG | 1492 |
| AD-1571035.1 | asasggccUfgUfGf AfggacuccaauL96 | 1976 | asUfsugdGa(G2p)ucc ucaCfaGfgccuusgsa | 2205 | UCAAGGCCUGU GAGGACUCCA AG | 1493 |
| AD-1571036.1 | gsgsccugUfgAfGf GfacuccaagauL96 | 1977 | asUfscudTg(G2p)agu ccuCfaCfaggccsusu | 2206 | AAGGCCUGUGA GGACUCCAAG AG | 1494 |
| AD-1571037.1 | gscscuguGfaGfGf AfcuccaagaguL96 | 1978 | asCfsucdTu(G2p)gag uccUfcAfcaggcscsu | 2207 | AGGCCUGUGAG GACUCCAAGA GA | 524 |
| AD-1571038.1 | csusacucUfgGfUf AfuuccuagguuL96 | 1979 | asCfscudAg(G2p)aaa uacCfaGfaguagscsa | 2208 | UGCUACUCUGG UAUUCCUAG GG | 529 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571039.1 | uscsugguAfuUfUf Cfcuaggguacul96 | 1980 | asGfsuadCc(C2p)uag gaaAfuAfccagasgsu | 2209 | ACUCUGGUAUU UCCUAGGGU ACA | 533 |
| AD-1571040.1 | csusgguaUfuUfCf Cfuaggguacaul96 | 1981 | asUfsgudAc(C2p)cua ggaAfaUfaccagsasg | 2210 | CUCUGGUAUUU CCUAGGGUAC AA | 1497 |
| AD-1571041.1 | usgsguauUfuCfCf Ufaggguacaaul96 | 1982 | asUfsugdTa(C2p)ccu aggAfaAfuaccasgsa | 2211 | UCUGGUAUUUC CUAGGGUAC AAG | 1498 |
| AD-1571042.1 | csusagggUfaCfAf Afggcggagguul96 | 1983 | asAfsccdTc(C2p)gcc uugUfaCfccuagsgsa | 2212 | UCCUAGGGUAC AAGGCGGAG GUG | 1501 |
| AD-1571043.1 | asusggucAfgCfCf Afgguguacucul96 | 1984 | asGfsagdTa(C2p)acc uggCfuGfaccauscsa | 2213 | UGAUGGUCAGC CAGGUGUAC UCA | 1502 |
| AD-1571044.1 | gsuscagcCfaGfGf Ufguacucagguul96 | 1985 | asCfscudGa(G2p)uac accUfgGfcugacscsa | 2214 | UGGUCAGCCAG GUGUACUCAG GC | 1503 |
| AD-1571045.1 | csasgccaGfgUfGf Ufacucaggcaul96 | 1986 | asUfsgcdCu(G2p)agu acaCfcUfggcugsasc | 2215 | GUCAGCCAGGU GUACUCAGGC AG | 1505 |
| AD-1571046.1 | csuscaauCfgCfCf Afcuucucccaul96 | 1987 | asUfsggdGa(G2p)aag uggCfgAfuugagsus a | 2216 | UACUCAAUCGC CACUUCUCCC AG | 1506 |
| AD-1571047.1 | csgsccacUfuCfUf Cfccaggaucuul96 | 1988 | asAfsgadTc(C2p)ugg gagAfaGfuggcgsasu | 2217 | AUCGCCACUUC UCCCAGGAUC UU | 1507 |
| AD-1571048.1 | gscscacuUfcUfCf Cfcaggaucuuul96 | 1989 | asAfsagdAu(C2p)cug ggaGfaAfguggcsgs a | 2218 | UCGCCACUUCU CCCAGGAUCU UA | 537 |
| AD-1571050.1 | uscsccagGfaUfCf Ufuacccgccgul96 | 1990 | asCfsggdCg(G2p)gua agaUfcCfugggasgsa | 2219 | UCUCCCAGGAU CUUACCCGCC GG | 539 |
| AD-1571051.1 | usasgugcCfuUfCf Cfgcagugaaaul96 | 1991 | asUfsuudCa(C2p)ugc ggaAfgGfcacuasgsa | 2220 | UCUAGUGCCUU CCGCAGUGAA AC | 1511 |
| AD-1571052.1 | csusuccgCfaGfUf Gfaaaccgccaul96 | 1992 | asUfsggdCg(G2p)uuu cacUfgCfggaagsgsc | 2221 | GCCUUCCGCAG UGAAACCGCC AA | 1513 |
| AD-1571053.1 | cscsgcagUfgAfAf Afccgccaaagul96 | 1993 | asCfsuudTg(G2p)cgg uuuCfaCfugcggsasa | 2222 | UUCCGCAGUGA AACCGCCAAA GC | 1514 |
| AD-1571054.1 | csgsgcaguGfaAfAf Cfcgccaaagcul96 | 1994 | asGfscudTu(G2p)gcg guuUfcAfcugcgsgsa | 2223 | UCCGCAGUGAA ACCGCCAAAG CC | 1515 |
| AD-1571055.1 | gscscaaaGfcCfCf Afgaagaugcuul96 | 1995 | asAfsgcdAu(C2p)uuc uggGfcUfuuggcsgs g | 2224 | CCGCCAAAGCC CAGAAGAUGC UC | 1520 |
| AD-1571056.1 | csasgcacCfcCfGf Cfugggaacuuul96 | 1996 | asAfsagdTu(C2p)cca ggcGfgGfugcugsgsu | 2225 | ACCAGCACCCG CCUGGGAACU UA | 1522 |
| AD-1571057.1 | ascsaacuCfcAfGf Cfuccgucuauul96 | 1997 | asAfsuadGa(C2p)gga gcuGfgAfguugusas g | 2226 | CUACAACUCCA GCUCCGUCUA UU | 1524 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571058.1 | csasccugCfuUfCfUfucugguucauL96 | 1998 | asUfsgadAc(C2p)agaagaAfgCfaggugsasg | 2227 | CUCACCUGCUUCUUCUGGUUCAU | 1525 |
| AD-1571059.1 | usgscuucUfuCfUfGfguucauucuuL96 | 1999 | asAfsgadAu(G2p)aaccagAfaGfaagcasgsg | 2228 | CCUGCUUCUUCUGGUUCAUUCUC | 547 |
| AD-1571060.1 | uscsuucuGfgUfUfCfauucuccaauL96 | 2000 | asUfsugdGa(G2p)aaugaaCfcAfgaagasasg | 2229 | CUUCUUCUGGUUCAUUCUCCAAA | 1527 |
| AD-1571061.1 | ususcuggUfuCfAfUfucuccaaauuL96 | 2001 | asAfsuudTg(G2p)agaaugAfaCfcagaasgsa | 2230 | UCUUCUGGUUCAUUCUCCAAAUC | 1529 |
| AD-1571062.1 | uscsugguUfcAfUfUfcuccaaaucuL96 | 2002 | asGfsaudTu(G2p)gagaauGfaAfccagasasg | 2231 | CUUCUGGUUCAUUCUCCAAAUCC | 1530 |
| AD-1571063.1 | gsusggagGfaGfCfUfgcuguccacuL96 | 2003 | asGfsugdGa(C2p)agcagcUfcCfuccacscsa | 2232 | UGGUGGAGGAGCUGCUGUCCACA | 1531 |
| AD-1571064.1 | gsasggagCfuGfCfUfguccacaguuL96 | 2004 | asAfscudGu(G2p)gacagcAfgCfuccucscsa | 2233 | UGGAGGAGCUGCUGUCCACAGUC | 1532 |
| AD-1571065.1 | asgscugcUfgUfCfCfacagucaacuL96 | 2005 | asGfsuudGa(C2p)uguggaCfaGfcagcuscsc | 2234 | GGAGCUGCUGUCCACAGUCAACA | 1533 |
| AD-1571066.1 | csusguccAfcAfGfUfcaacagcucuL96 | 2006 | asGfsagdCu(C2p)uugacuGfuGfgacagscsa | 2235 | UGCUGUCCACAGUCAACAGCUCG | 1536 |
| AD-1571067.1 | ascsagggCfcGfAfGfuacgaagucuL96 | 2007 | asCfsacdTu(C2p)guacucGfgCfccugusasg | 2236 | CUACAGGGCCGAGUACGAAGUGG | 552 |
| AD-1571068.1 | gsgsgccgAfgUfAfCfgaaguggacuL96 | 2008 | asGfsucdCa(C2p)uucguaCfuCfggcccsusg | 2237 | CAGGGCCGAGUACGAAGUGGACC | 1538 |
| AD-1571069.1 | uscscuggAfaGfCfCfagugugaaauL96 | 2009 | asUfsuudCa(C2p)acuggcUfuCfcaggasusc | 2238 | GAUCCUGGAAGCCAGUGUGAAAG | 1541 |
| AD-1571070.1 | csusggaaGfcCfAfGfugugaaagauL96 | 2010 | asUfscudTu(C2p)acacugGfcUfuccagsgsa | 2239 | UCCUGGAAGCCAGUGUGAAAGAC | 1543 |
| AD-1571071.1 | asasgccaGfuGfUfGfaaagacauauL96 | 2011 | asUfsaudGu(C2p)uuucacAfcUfggcuuscsc | 2240 | GGAAGCCAGUGUGAAAGACAUAG | 1547 |
| AD-1571072.1 | gscscaguGfuGfAfAfagacauagcuL96 | 2012 | asGfscudAu(G2p)ucuuucAfcAfcuggcsusu | 2241 | AAGCCAGUGUGAAAGACAUAGCU | 1549 |
| AD-1571074.1 | usgsugaaAfgAfCfAfuagcugcauuL96 | 2013 | asAfsugdCa(G2p)cuauguCfuUfucacascsu | 2242 | AGUGUGAAAGACAUAGCUGCAUU | 1552 |
| AD-1571075.1 | ascsgcugGfgUfUfGfuuaccgcuauL96 | 2014 | asUfsagdCg(G2p)uaacaaCfcCfagcgusgsg | 2243 | CCACGCUGGGUUGUUACCGCUAC | 1554 |
| AD-1571076.1 | csgscuggGfuUfGfUfuaccgcuacuL96 | 2015 | asGfsuadGc(G2p)guaacaAfcCfcagcgsusg | 2244 | CACGCUGGGUUGUUACCGCUACA | 1555 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
| --- | --- | --- | --- | --- | --- | --- |
| AD-1571077.1 | gscsugggUfuGfUf UfaccgcuacauL96 | 2016 | asUfsgudAg(C2p)ggu aacAfaCfccagcsgsu | 2245 | ACGCUGGGUUG UUACCGCUAC AG | 1556 |
| AD-1571078.1 | csusggguUfgUfUf AfccgcuacaguL96 | 2017 | asCfsugdTa(G2p)cgg uaaCfaAfcccagscsg | 2246 | CGCUGGGUUGU UACCGCUACA GC | 563 |
| AD-1571079.1 | csusggagAfaGfAf GfgcucaucacuL96 | 2018 | asGfsugdAu(G2p)agc cucUfuCfuccagsgsg | 2247 | CCCUGGAGAAG AGGCUCAUCA CC | 1561 |
| AD-1571080.1 | gsasgaagAfgGfCf UfcaucaccucuL96 | 2019 | asGfsagdGu(G2p)aug agcCfuCfuucucscsa | 2248 | UGGAGAAGAGG CUCAUCACCU CG | 1564 |
| AD-1571081.1 | gsasagagGfcUfCf AfucaccucgguL96 | 2020 | asCfscgdAg(G2p)uga ugaGfcCfucuucsusc | 2249 | GAGAAGAGGCU CAUCACCUCG GU | 1565 |
| AD-1571082.1 | asgsgcucAfuCfAf CfcucgguguauL96 | 2021 | asUfsacdAc(C2p)gag gugAfuGfagccuscsu | 2250 | AGAGGCUCAUC ACCUCGGUGU AC | 571 |
| AD-1571083.1 | asasgaagGfgCfCf UfgcacagcuauL96 | 2022 | asUfsagdCu(G2p)ugc aggCfcCfuucuuscsc | 2251 | GGAAGAAGGGC CUGCACAGCU AC | 1567 |
| AD-1571084.1 | asasgggcCfuGfCf AfcagcuacuauL96 | 2023 | asUfsagdTa(G2p)cug ugcAfgGfcccuuscsu | 2252 | AGAAGGGCCUG CACAGCUACU AC | 1568 |
| AD-1571085.1 | cscsucucUfgGfAf CfuacggcuuguL96 | 2024 | asCfsaadGc(C2p)gua gucCfaGfagaggsgsc | 2253 | GCCCUCUCUGG ACUACGGCUU GG | 574 |
| AD-1571086.1 | uscsucugGfaCfUf AfcggcuuggcuL96 | 2025 | asGfsccdAa(C2p)ccg uagUfcCfagagasgsg | 2254 | CCUCUCUGGAC UACGGCUUGG CC | 575 |
| AD-1571087.1 | usgsgacuAfcGfGf CfuuggcccucuL96 | 2026 | asGfsagdGg(C2p)caa gccGfuAfguccasgsa | 2255 | UCUGGACUACG GCUUGGCCCU CU | 1570 |
| AD-1571088.1 | gsgsacuaCfgGfCf UfuggcccucuuL96 | 2027 | asAfsgadGg(G2p)cca agcCfgUfaguccsasg | 2256 | CUGGACUACGG CUUGGCCCUC UG | 1571 |
| AD-1571089.1 | asgsaaguAfuGfAf UfuugccgugcuL96 | 2028 | asGfscadCg(G2p)caa aucAfuAfcuucusgsc | 2257 | GCAGAAGUAUG AUUUGCCGU GCA | 587 |
| AD-1571090.1 | gsasaguaUfgAfUf UfugccgugcauL96 | 2029 | asUfsgcdAc(C2p)gca aauCfaUfacuucsusg | 2258 | CAGAAGUAUGA UUUGCCGUG CAC | 588 |
| AD-1571091.1 | asasguauGfaUfUf UfgccgugcacuL96 | 2030 | asGfsugdCa(C2p)ggc aaaUfcAfuacuuscsu | 2259 | AGAAGUAUGAU UUGCCGUGC ACC | 1573 |
| AD-1571092.1 | gsusaugaUfuUfGf CfcgugcacccuL96 | 2031 | asGfsggdTg(C2p)acg gcaAfaUfcauacsusu | 2260 | AAGUAUGAUUU GCCGUGCACC CA | 1575 |
| AD-1571093.1 | gsgsccagUfgGfAf CfgauccagaauL96 | 2032 | asUfsucdTg(G2p)auc gucCfaCfuggccscsu | 2261 | AGGGCCAGUGG ACGAUCCAGA AC | 1576 |
| AD-1571094.1 | gscscaguGfgAfCf GfauccagaacuL96 | 2033 | asGfsuudCu(G2p)gau cguCfcAfcuggcscsc | 2262 | GGGCCAGUGGA CGAUCCAGAA CA | 1577 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571096.1 | usgsgacgAfuCfCfAfgaacaggaguL96 | 2034 | asCfsucdCu(G2p)uucuggAfuCfguccascsu | 2263 | AGUGGACGAUCCAGAACAGGAGG | 1579 |
| AD-1571097.1 | csasccucCfcAfGfAfucucccucauL96 | 2035 | asUfsgadGg(G2p)agaucuGfgGfaggugsasa | 2264 | UUCACCUCCCAGAUCUCCCUCAC | 1581 |
| AD-1571098.1 | usgscgggUfgCfAfCfuauggcuuguL96 | 2036 | asCfsaadGc(C2p)auagugCfaCfccgcascsa | 2265 | UGUGCGGGUGCACUAUGGCUUGU | 1582 |
| AD-1571099.1 | gscsggguGfcAfCfUfauggcuuguL96 | 2037 | asAfscadAg(C2p)cauaguGfcAfcccgcsasc | 2266 | GUGCGGGUGCACUAUGGCUUGUA | 595 |
| AD-1571100.1 | csgsggugCfaCfUfAfuggcuuguauL96 | 2038 | asUfsacdAa(G2p)ccauagUfgCfacccgcsasc | 2267 | UGCGGGUGCACUAUGGCUUGUAC | 1583 |
| AD-1571102.1 | asasccggcCfuGfGfAfugagagaaauL96 | 2039 | asUfsuudCu(C2p)ucauccAfgGfccguusgsg | 2268 | CCAACGGCCUGGAUGAGAGAAAC | 1588 |
| AD-1571103.1 | csgsgccuGfgAfUfGfagagaaacuuL96 | 2040 | asAfsgudTu(C2p)ucucauCfcAfggccgsusu | 2269 | AACGGCCUGGAUGAGAGAAACUG | 1590 |
| AD-1571104.1 | gsasgaaaCfuGfCfGfuuugcagaguL96 | 2041 | asCfsucdTg(C2p)aaacgcAfgUfuucucsusc | 2270 | GAGAGAAACUGCGUUUGCAGAGC | 1593 |
| AD-1571105.1 | csusgcguUfuGfCfAfgagccacauuL96 | 2042 | asAfsgudTg(G2p)cucugcAfaAfcgcagsusu | 2271 | AACUGCGUUUGCAGAGCCACAUU | 1594 |
| AD-1571106.1 | usgscguuUfgCfAfGfagccacauuuL96 | 2043 | asAfsaudGu(G2p)gcucugCfaAfacgcasgsu | 2272 | ACUGCGUUUGCAGAGCCACAUUC | 1595 |
| AD-1571107.1 | csgsuuugCfaGfAfGfccacauuccuL96 | 2044 | asGfsgadAu(G2p)uggcucUfgCfaaacgscsa | 2273 | UGCGUUUGCAGAGCCACAUUCA | 1597 |
| AD-1571108.1 | gscsagagCfcAfCfAfuuccagugcuL96 | 2045 | asGfscadCu(G2p)gaauguGfgCfucugcsasa | 2274 | UUGCAGAGCCACAUUCCAGUGCA | 1598 |
| AD-1571109.1 | gsgsgacaUfuCfAfCfcuuccaguguL96 | 2046 | asCfsacdTg(G2p)aagguGfaAfugucccsasc | 2275 | GUGGGACAUUCACCUUCCAGUGU | 1599 |
| AD-1571110.1 | gsgsgacauUfcAfCfCfuuccaguuuL96 | 2047 | asAfscadCu(G2p)gaagGfuGfaAfugucscsa | 2276 | UGGGACAUUCACCUUCCAGUGUG | 607 |
| AD-1571111.1 | ascsauucAfcCfCfUfuccagugauL96 | 2048 | asUfscadCa(C2p)uggaagGfuGfaauguscsc | 2277 | GGACAUUCACCUUCCAGUGUGAG | 609 |
| AD-1571112.1 | asgscugcGfuGfAfAfgaagcccaauL96 | 2049 | asUfsugdGg(C2p)uucuucAfcGfcagcuscsc | 2278 | GGAGCUGCGUGAAGAAGCCCAAC | 1601 |
| AD-1571113.1 | gscsugcgUfgAfAfGfaagcccaacuL96 | 2050 | asGfsuudGg(G2p)cuucuuCfaCfgcagcsusc | 2279 | GAGCUGCGUGAAGAAGCCCAACC | 1602 |
| AD-1571114.1 | csusgcguGfaAfGfAfagcccaaccuL96 | 2051 | asGfsgudTg(G2p)gcuucuUfcAfcgcagscsu | 2280 | AGCUGCGUGAAGAAGCCCAACCC | 1603 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571115.1 | usgscugAfaGfAfAfgcccaacccuL96 | 2052 | asGfsggdTu(G2p)ggcuucUfuCfacgcasgsc | 2281 | GCUGCGUGAAGAAGCCCAACCCG | 1604 |
| AD-1571116.1 | asgscacuGfuGfAfCfuguggcucucuL96 | 2053 | asGfsagdGc(C2p)acagucAfcAfgugcuscsc | 2282 | GGAGCACUGUGACUGUGGCCUCC | 1605 |
| AD-1571117.1 | csusccgaGfgGfUfGfaguggccauuL96 | 2054 | asAfsugdGc(C2p)acucacCfcUfcggagsgsa | 2283 | UCCUCCGAGGGUGAGUGGCCAUG | 1606 |
| AD-1571118.1 | asuscgcuGfaCfCfGfcugggugauuL96 | 2055 | asAfsucdAc(C2p)cagcggUfcAfgcgausgsa | 2284 | UCAUCGCUGACCGCUGGGUGAUA | 611 |
| AD-1571119.1 | uscsgcugAfcCfGfCfugggugauauL96 | 2056 | asUfsaudCa(C2p)ccagcgGfuCfagcgasusg | 2285 | CAUCGCUGACCGCUGGGUGAUAA | 1607 |
| AD-1571120.1 | gscsugacCfgCfUfGfggugauaacuL96 | 2057 | asGfsuudAu(C2p)acccagCfgGfucagcsgsa | 2286 | UCGCUGACCGCUGGGUGAUAACA | 1609 |
| AD-1571121.1 | gscsugggUfgAfUfAfacagcugccuL96 | 2058 | asGfsgcdAg(C2p)uguauCfaCfccagcsgsg | 2287 | CCGCUGGGUGAUAACAGCUGCCC | 1610 |
| AD-1571122.1 | usgscuucCfaGfGfAfggacagcauuL96 | 2059 | asAfsugdCu(G2p)uccuccUfgGfaagcasgsu | 2288 | ACUGCUUCCAGGAGGACAGCAUG | 1611 |
| AD-1571123.1 | csusuccaGfgAfGfGfacagcauggcuL96 | 2060 | asCfscadTg(C2p)uguccuCfcUfggaagscsa | 2289 | UGCUUCCAGGAGGACAGCAUGGC | 1613 |
| AD-1571124.1 | csusgggcAfaGfGfUfguggcagaauL96 | 2061 | asUfsucdTg(C2p)cacaccUfuGfcccagsgsa | 2290 | UCCUGGGCAAGGUGUGGCAGAAC | 1614 |
| AD-1571125.1 | usgsgggcAfaGfGfUfGfuggcagaacuL96 | 2062 | asGfsuudCu(C2p)ccacacCfuUfgcccasgsg | 2291 | CCUGGGCAAGGUGUGGCAGAACU | 1615 |
| AD-1571126.1 | gsgscaagGfuGfUfGfgcagaacucuL96 | 2063 | asGfsagdTu(C2p)ugccacAfcCfuugccscsa | 2292 | UGGGCAAGGUGUGGCAGAACUCG | 1617 |
| AD-1571127.1 | usgsgccuGfgAfGfGfuguccuuuL96 | 2064 | asAfsagdGa(C2p)accucuCfcAfggccasgsc | 2293 | GCUGGCCUGGAGGUGUCCUUC | 1619 |
| AD-1571128.1 | gscscuggAfgAfGfGfuguccuucauL96 | 2065 | asUfsgadAg(G2p)acaccuCfuCfcaggcscsa | 2294 | UGGCCUGGAGAGGUGUCCUUCAA | 1621 |
| AD-1571129.1 | cscsuggaGfaGfGfUfguccuucaauL96 | 2066 | asUfsugdAa(G2p)gacaccUfcUfccaggscsc | 2295 | GGCCUGGAGAGGUGUCCUUCAAG | 1622 |
| AD-1571130.1 | usgsugcaGfuUfGfAfucccacagguL96 | 2067 | asCfscudGu(G2p)ggaucaAfcUfgcacasusc | 2296 | GAUGUGCAGUUGAUCCCACAGGA | 1623 |
| AD-1571131.1 | usgscaguUfgAfUfCfccacaggacuL96 | 2068 | asGfsucdCu(G2p)ugggauCfaAfcugcascsa | 2297 | UGUGCAGUUGAUCCCACAGGACC | 1624 |
| AD-1571132.1 | asuscccaCfaGfGfAfccgugcaguL96 | 2069 | asCfsugdCa(C2p)aggucCfuUfgUfgggauscsa | 2298 | UGAUCCCACAGGACCUGUGCAGC | 621 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571133.1 | cscscacaGfgAfCfCfugugcagcguL96 | 2070 | asCfsgcdTg(C2p)acagguCfcUfgugggsasu | 2299 | AUCCCACAGGACCUGUGCAGCGA | 1625 |
| AD-1571134.1 | cscsacagGfaCfCfUfgugcagcgauL96 | 2071 | asUfscgdCu(G2p)cacaggUfcCfguggsgsa | 2300 | UCCCACAGGACCUGUGCAGCGAG | 1626 |
| AD-1571135.1 | cscsagguGfaCfGfCfcacgcaugcuL96 | 2072 | asGfscadTg(C2p)gugcgUfcAfccuggsusa | 2301 | UACCAGGUGACGCCACGCAUGCU | 1627 |
| AD-1571136.1 | gsusgacgCfcAfCfGfcaugcuguguL96 | 2073 | asCfsacdAg(C2p)augcguGfgCfgucacscsu | 2302 | AGGUGACGCCACGCAUGCUGUGU | 1628 |
| AD-1571137.1 | usgsacgcCfaCfGfCfaugcuguuL96 | 2074 | asAfscadCa(G2p)caugcgUfgGfcgucascsc | 2303 | GGUGACGCCACGCAUGCUGUGUG | 622 |
| AD-1571138.1 | ascsgccaCfgCfAfUfgcugugcuL96 | 2075 | asGfscadCa(C2p)agcaugCfgUfggcguscsa | 2304 | UGACGCCACGCAUGCUGUGUGCC | 1629 |
| AD-1571139.1 | gsgscuacCfgCfAfAfgggcaagaauL96 | 2076 | asUfsucdTu(G2p)cccuugCfgGfuagccsgsg | 2305 | CCGGCUACCGCAAGGGCAAGAAG | 1630 |
| AD-1571140.1 | gsusgcaaGfcCfAfCfucaguggccuL96 | 2077 | asGfsgcdCa(C2p)ugagugCfcCfugcacsasc | 2306 | GUGUGCAAGGCACUCAGUGGCCG | 1631 |
| AD-1571141.1 | csusaacuAfcUfUfCfggcgucuacuL96 | 2078 | asGfsuadGa(C2p)gccgaaGfuAfguuagsgsc | 2307 | GCCUAACUACUUCGGCGUCUACA | 1632 |
| AD-1571142.1 | csusacacCfcGfCfAfucacaggguL96 | 2079 | asCfsacdCu(G2p)ugagcGfgGfuguagsasc | 2308 | GUCUACACCCGCAUCACAGGUGU | 628 |
| AD-1571143.1 | cscscgcaUfcAfCfAfggugugaucuL96 | 2080 | asGfsaudCa(C2p)accuguGfaUfgcgggsusg | 2309 | CACCCGCAUCACAGGUGUGAUCA | 1638 |
| AD-1571144.1 | usgsgaucCfaGfCfAfaguggugacuL96 | 2081 | asGfsucdAc(C2p)acuugcUfgGfauccasgsc | 2310 | GCUGGAUCCAGCAAGUGGUGACC | 1639 |
| AD-1571145.1 | asusccagCfaAfGfUfggugaccuguL96 | 2082 | asCfsagdGu(C2p)accacuUfgCfuggauscsc | 2311 | GGAUCCAGCAAGUGGUGACCUGA | 1641 |
| AD-1571146.1 | cscsagcaAfgUfGfGfugaccugaguL96 | 2083 | asCfsucdAg(G2p)ucaccaCfuUfgcuggsasu | 2312 | AUCCAGCAAGUGGUGACCUGAGG | 1642 |
| AD-1571147.1 | csasgcaaGfuGfGfUfgaccugagguL96 | 2084 | asCfscudCa(G2p)gucaccAfcUfugcugsgsa | 2313 | UCCAGCAAGUGGUGACCUGAGGA | 1643 |
| AD-1571148.1 | gscsaaguGfgUfGfAfccugaggaauL96 | 2085 | asUfsucdCu(C2p)aggucaCfcAfcuugcsusg | 2314 | CAGCAAGUGGUGACCUGAGGAAC | 1644 |
| AD-1571149.1 | usgsguggCfaGfGfAfgguggcaucuL96 | 2086 | asGfsaudGc(C2p)accuccUfgCfcaccascsa | 2315 | UGUGGUGGCAGGAGGUGGCAUCU | 1645 |
| AD-1571150.1 | gsgsuggcAfgGfAfGfguggcaucuuL96 | 2087 | asAfsgadTg(C2p)caccucCfuGfccaccsasc | 2316 | GUGGUGGCAGGAGGUGGCAUCUU | 1646 |

TABLE 7-continued

Modified Sense and Antisense Strand Sequences of TMPRSS6 dsRNA Agents

| Duplex Name | Sense Strand Sequence 5' to 3' | SEQ ID NO: | Antisense Strand Sequence 5' to 3' | SEQ ID NO: | mRNA Target Sequence 5' to 3' | SEQ ID NO: |
|---|---|---|---|---|---|---|
| AD-1571151.1 | gsusggcaGfgAfGf GfuggcaucuuuL96 | 2088 | asAfsagdAu(G2p)cca ccuCfcUfgccacscsa | 2317 | UGGUGGCAGGA GGUGGCAUC UUG | 1647 |
| AD-1571152.1 | uscscaguGfaUfGf GfcaggaggauuL96 | 2089 | asAfsucdCu(C2p)cug ccaUfcAfcuggasgsc | 2318 | GCUCCAGUGAU GGCAGGAGG AUG | 1650 |
| AD-1571153.1 | csusaacuUfgGfGf AfucugggaauuL96 | 2090 | asAfsuudCc(C2p)aga uccCfaAfguuagsasc | 2319 | GUCUAACUUGG GAUCUGGGA AUG | 1651 |
| AD-1571154.1 | gsusgagcUfcAfGf CfugcccuuuguL96 | 2091 | asCfsaadAg(G2p)gca gcuGfaGfcucacscsu | 2320 | AGGUGAGCUCA GCUGCCCUUU GG | 1652 |
| AD-1571155.1 | csuscagcUfgCfCf CfuuuggaauauL96 | 2092 | asUfsaudTc(C2p)aaa gggCfaGfcugagscsu | 2321 | AGCUCAGCUGC CCUUUGGAAU AA | 1653 |
| AD-1571156.1 | uscsagcuGfcCfCf UfuuggaauaauL96 | 2093 | asUfsuadTu(C2p)caa aggGfcAfgcugasgsc | 2322 | GCUCAGCUGCC CUUUGGAAUA AA | 1654 |
| AD-1571157.1 | cscscuuuGfgAfAf UfaaagcugccuL96 | 2094 | asGfsgcdAg(C2p)uuu auuCfcAfaagggscsa | 2323 | UGCCCUUUGGA AUAAAGCUGC cu | 1657 |
| AD-1571158.1 | cscsuuugGfaAfUf AfaagcugccuuL96 | 2333 | asAfsggdCa(G2p)cuu uauUfcCfaaaggsgsc | 2324 | GCCCUUUGGAA UAAAGCUGCC UG | 1658 |
| AD-1571159.1 | ususuggaAfuAfAf AfgcugccugauL96 | 2096 | asUfscadGg(C2p)agc uuuAfuUfccaaasgsg | 2325 | CCUUUGGAAUA AAGCUGCCUG AU | 1659 |
| AD-1571160.1 | ususggaaUfaAfAf GfcugccugauuL96 | 2097 | asAfsucdAg(G2p)cag cuuUfaUfuccaasasg | 2326 | CUUUGGAAUAA AGCUGCCUG AUC | 1660 |
| AD-1571161.1 | usgsgaauAfaAfAfGf CfugccugaucuL96 | 2098 | asGfsaudCa(G2p)gca gcuUfuAfuuccasasa | 2327 | UUUGGAAUAAA GCUGCCUGA UCC | 1661 |

TABLE 8

Single Dose Screen in Hep3b Cells

| Duplex | 10 nM Avg % message remaining | St. Dev | 1 nM Avg % message remaining | St. Dev | 0.1 nM Avg % message remaining | St. Dev |
|---|---|---|---|---|---|---|
| AD-1570929.1 | 55 | 8 | 73 | 7 | 55 | 8 |
| AD-1571034.1 | 76 | 5 | 94 | 7 | 129 | 8 |
| AD-1571035.1 | 62 | 15 | 73 | 11 | 82 | 8 |
| AD-1571036.1 | 53 | 8 | 75 | 11 | 92 | 4 |
| AD-1554875.1 | 14 | 3 | 21 | 4 | 30 | 5 |
| AD-1571037.1 | 29 | 7 | 44 | 12 | 98 | 9 |
| AD-1570930.1 | 15 | 3 | 22 | 3 | 30 | 2 |
| AD-1570931.1 | 11 | 2 | 14 | 1 | 21 | 8 |
| AD-1554909.1 | 22 | 6 | 39 | 1 | 44 | 8 |
| AD-1554910.1 | 21 | 4 | 30 | 3 | 39 | 7 |
| AD-1554911.1 | 21 | 3 | 32 | 10 | 36 | 5 |
| AD-1554912.1 | 21 | 3 | 46 | 3 | 51 | 5 |
| AD-1554913.1 | 50 | 6 | 71 | 15 | 66 | 13 |
| AD-1571038.1 | 95 | 21 | 96 | 9 | 121 | 9 |
| AD-1554914.1 | 47 | 8 | 74 | 9 | 70 | 9 |
| AD-1554915.1 | 28 | 3 | 51 | 9 | 50 | 7 |
| AD-1554916.1 | 34 | 5 | 54 | 8 | 64 | 8 |
| AD-1570932.1 | 17 | 3 | 34 | 5 | 55 | 8 |
| AD-1554917.1 | 25 | 5 | 47 | 4 | 52 | 8 |
| AD-1571039.1 | 31 | 3 | 55 | 13 | 89 | 10 |
| AD-1571040.1 | 37 | 8 | 43 | 11 | 86 | 11 |
| AD-1571041.1 | 36 | 9 | 61 | 16 | 97 | 32 |
| AD-1570933.1 | 92 | 14 | 109 | 22 | 97 | 3 |
| AD-1570934.1 | 80 | 11 | 103 | 9 | 71 | 9 |
| AD-1554923.1 | 41 | 6 | 79 | 16 | 72 | 7 |
| AD-1571042.1 | 69 | 19 | 70 | 4 | 93 | 5 |
| AD-1571043.1 | 56 | 11 | 81 | 16 | 107 | 8 |
| AD-1554951.1 | 32 | 5 | 59 | 2 | 56 | 7 |
| AD-1570935.1 | 60 | 12 | 79 | 12 | 73 | 7 |
| AD-1571044.1 | 78 | 9 | 64 | 14 | 122 | 21 |
| AD-1570936.1 | 103 | 24 | 105 | 13 | 102 | 22 |
| AD-1571045.1 | 76 | 15 | 99 | 15 | 122 | 22 |
| AD-1554955.1 | 31 | 6 | 48 | 4 | 51 | 6 |
| AD-1570937.1 | 27 | 5 | 54 | 3 | 61 | 3 |

TABLE 8-continued

Single Dose Screen in Hep3b Cells

| Duplex | 10 nM Avg % message remaining | St. Dev | 1 nM Avg % message remaining | St. Dev | 0.1 nM Avg % message remaining | St. Dev |
|---|---|---|---|---|---|---|
| AD-1571046.1 | 37 | 9 | 60 | 16 | 87 | 16 |
| AD-1571047.1 | 23 | 3 | 28 | 7 | 45 | 9 |
| AD-1554992.1 | 85 | 6 | 99 | 9 | 75 | 2 |
| AD-1571048.1 | 74 | 14 | 98 | 10 | ill | 20 |
| AD-1570938.1 | 36 | 4 | 71 | 12 | 70 | 11 |
| AD-1554997.1 | 24 | 6 | 43 | 3 | 50 | 4 |
| AD-1570939.1 | ill | 16 | 117 | 11 | 84 | 8 |
| AD-1555000.1 | 30 | 5 | 51 | 4 | 64 | 12 |
| AD-1571050.1 | 51 | 10 | 87 | 6 | 88 | 8 |
| AD-1571051.1 | 44 | 7 | 68 | 18 | 77 | 15 |
| AD-1555030.1 | 30 | 6 | 61 | 7 | 57 | 9 |
| AD-1570940.1 | 27 | 4 | 62 | 6 | 70 | 6 |
| AD-1570941.1 | 103 | 16 | 113 | 11 | 79 | 10 |
| AD-1571052.1 | 23 | 4 | 38 | 1 | 40 | 7 |
| AD-1571053.1 | 31 | 2 | 58 | 14 | 76 | 5 |
| AD-1571054.1 | 28 | 5 | 46 | 5 | 56 | 6 |
| AD-1570942.1 | 47 | 4 | 70 | 5 | 76 | 8 |
| AD-1570943.1 | 27 | 7 | 42 | 3 | 68 | 4 |
| AD-1570944.1 | 38 | 6 | 36 | 4 | 62 | 6 |
| AD-1570945.1 | 52 | 8 | 87 | 7 | 67 | 4 |
| AD-1571055.1 | 43 | 6 | 68 | 12 | 83 | 10 |
| AD-1570946.1 | 80 | 11 | 89 | 11 | 82 | 4 |
| AD-1571056.1 | 44 | 3 | 70 | 13 | 87 | 13 |
| AD-1570947.1 | 54 | 9 | 80 | 14 | 84 | 9 |
| AD-1571057.1 | 43 | 3 | 62 | 6 | 67 | 14 |
| AD-1555106.1 | 16 | 5 | 17 | 2 | 35 | 8 |
| AD-1570948.1 | 26 | 7 | 34 | 6 | 53 | 7 |
| AD-1555112.1 | 33 | 5 | 61 | 4 | 64 | 8 |
| AD-1571028.1 | 65 | 8 | 87 | 6 | 105 | 10 |
| AD-1571029.1 | 69 | 12 | 83 | 4 | 112 | 19 |
| AD-1555114.1 | 25 | 6 | 36 | 3 | 43 | 12 |
| AD-1555115.1 | 26 | 5 | 38 | 4 | 40 | 6 |
| AD-1570949.1 | 29 | 5 | 45 | 3 | 56 | 8 |
| AD-1571030.1 | 37 | 2 | 61 | 12 | 74 | 12 |
| AD-1571031.1 | 46 | 11 | 64 | 14 | 79 | 10 |
| AD-1571058.1 | 34 | 4 | 44 | 3 | 53 | 5 |
| AD-1555117.1 | 23 | 6 | 27 | 5 | 38 | 2 |
| AD-1571032.1 | 54 | 1 | 80 | 14 | 86 | 7 |
| AD-1571033.1 | 44 | 5 | 80 | 11 | 101 | 23 |
| AD-1555118.1 | 30 | 7 | 33 | 3 | 47 | 5 |
| AD-1570950.1 | 31 | 6 | 44 | 5 | 63 | 5 |
| AD-1570951.1 | 28 | 6 | 33 | 7 | 46 | 3 |
| AD-1555120.1 | 24 | 6 | 33 | 4 | 53 | 11 |
| AD-1571059.1 | 28 | 5 | 44 | 6 | 55 | 5 |
| AD-1555121.1 | 36 | 5 | 55 | 4 | 69 | 7 |
| AD-1555122.1 | 22 | 4 | 32 | 5 | 49 | 6 |
| AD-1570952.1 | 25 | 4 | 45 | 5 | 52 | 8 |
| AD-1555123.1 | 35 | 7 | 43 | 1 | 70 | 5 |
| AD-1570953.1 | 93 | 6 | 102 | 14 | 101 | 12 |
| AD-1571060.1 | 25 | 4 | 42 | 9 | 53 | 11 |
| AD-1570954.1 | 23 | 6 | 32 | 3 | 72 | 17 |
| AD-1571061.1 | 22 | 3 | 35 | 3 | 43 | 3 |
| AD-1571062.1 | 44 | 7 | 68 | 5 | 87 | 15 |
| AD-1555128.1 | 36 | 7 | 41 | 6 | 63 | 15 |
| AD-1570955.1 | 31 | 8 | 35 | 2 | 48 | 9 |
| AD-1571063.1 | 80 | 10 | 88 | 14 | 89 | 6 |
| AD-1571064.1 | 87 | 8 | 94 | 6 | 123 | 6 |
| AD-1571065.1 | 68 | 4 | 80 | 9 | 93 | 8 |
| AD-1570956.1 | 48 | 9 | 76 | 7 | 93 | 19 |
| AD-1570957.1 | 50 | 11 | 66 | 3 | 82 | 14 |
| AD-1571066.1 | 35 | 5 | 43 | 9 | 82 | 26 |
| AD-1570958.1 | 69 | 12 | 102 | 7 | 92 | 3 |
| AD-1555184.1 | 87 | 13 | 100 | 12 | 99 | 5 |
| AD-1571067.1 | 80 | 18 | 77 | 11 | 93 | 12 |
| AD-1555185.1 | 63 | 15 | 88 | 15 | 100 | 13 |
| AD-1571068.1 | 71 | 10 | 55 | 6 | 73 | 15 |
| AD-1570959.1 | 104 | 13 | 106 | 9 | 85 | 6 |
| AD-1570960.1 | 48 | 9 | 62 | 18 | 79 | 16 |
| AD-1571069.1 | 57 | 5 | 41 | 10 | 81 | 9 |
| AD-1570961.1 | 73 | 12 | 101 | 2 | 94 | 13 |
| AD-1571070.1 | 48 | 5 | 44 | 11 | 78 | 8 |
| AD-1570962.1 | 57 | 11 | 88 | 6 | 82 | 13 |
| AD-1570963.1 | 33 | 6 | 52 | 4 | 50 | 8 |
| AD-1570964.1 | 52 | 10 | 83 | 7 | 92 | 19 |
| AD-1571071.1 | 59 | 4 | 65 | 6 | 85 | 16 |
| AD-1570965.1 | 86 | 17 | 109 | 12 | 100 | 16 |
| AD-1571072.1 | 72 | 6 | 75 | 4 | 120 | 8 |
| AD-1555212.1 | 42 | 11 | 56 | 7 | 71 | 13 |
| AD-1570966.1 | 32 | 5 | 39 | 9 | 58 | 6 |
| AD-1555213.1 | 33 | 6 | 36 | 5 | 47 | 7 |
| AD-1570967.1 | 35 | 8 | 58 | 10 | 52 | 4 |
| AD-1571074.1 | 19 | 3 | 31 | 6 | 33 | 4 |
| AD-1570968.1 | 30 | 6 | 41 | 4 | 44 | 7 |
| AD-1555234.1 | 30 | 6 | 41 | 6 | 56 | 5 |
| AD-1570969.1 | 42 | 8 | 62 | 10 | 61 | 8 |
| AD-1555235.1 | 51 | 9 | 77 | 12 | 72 | 5 |
| AD-1555236.1 | 59 | 7 | 67 | 15 | 68 | 3 |
| AD-1555238.1 | 45 | 8 | 55 | 9 | 58 | 1 |
| AD-1570970.1 | 77 | 10 | 88 | 32 | 74 | 6 |
| AD-1555241.1 | 41 | 6 | 57 | 10 | 39 | 9 |
| AD-1555242.1 | 47 | 6 | 83 | 6 | 71 | 3 |
| AD-1555243.1 | 41 | 8 | 65 | 7 | 67 | 4 |
| AD-1570971.1 | 93 | 11 | 108 | 8 | 92 | 14 |
| AD-1571075.1 | 25 | 5 | 37 | 5 | 38 | 3 |
| AD-1571076.1 | 15 | 4 | 33 | 9 | 41 | 8 |
| AD-1571077.1 | 39 | 9 | 43 | 13 | 46 | 11 |
| AD-1555247.1 | 42 | 4 | 51 | 4 | 78 | 8 |
| AD-1571078.1 | 16 | 3 | 40 | 14 | 49 | 4 |
| AD-1570972.1 | 53 | 15 | 67 | 39 | 40 | 18 |
| AD-1570973.1 | 45 | 5 | 35 | 8 | 55 | 8 |
| AD-1570974.1 | 76 | 12 | 81 | 16 | 81 | 9 |
| AD-1555342.1 | 73 | 16 | 69 | 3 | 78 | 18 |
| AD-1570975.1 | 108 | 21 | 84 | 15 | 103 | 13 |
| AD-1555343.1 | 80 | 12 | 92 | 5 | 91 | 9 |
| AD-1555345.1 | 84 | 10 | 97 | 6 | 103 | 13 |
| AD-1555346.1 | 54 | 12 | 71 | 7 | 86 | 3 |
| AD-1570976.1 | 71 | 11 | 70 | 9 | 93 | 5 |
| AD-1555348.1 | 57 | 22 | 64 | 6 | 84 | 12 |
| AD-1555349.1 | 36 | 8 | 50 | 2 | 66 | 7 |
| AD-1555350.1 | 57 | 9 | 58 | 10 | 77 | 10 |
| AD-1571079.1 | 71 | 12 | 77 | 10 | 65 | 11 |
| AD-1570977.1 | 34 | 8 | 68 | 10 | 92 | 8 |
| AD-1570978.1 | 30 | 13 | 53 | 4 | 86 | 5 |
| AD-1571080.1 | 63 | 11 | 70 | 3 | 71 | 14 |
| AD-1571081.1 | 76 | 12 | 79 | 3 | 94 | 16 |
| AD-1555366.1 | 42 | 4 | 48 | 2 | 78 | 2 |
| AD-1571082.1 | 37 | 3 | 54 | 5 | 56 | 11 |
| AD-1570979.1 | 31 | 8 | 54 | 12 | 72 | 10 |
| AD-1571083.1 | 45 | 4 | 54 | 6 | 56 | 8 |
| AD-1571084.1 | 34 | 1 | 53 | 11 | 58 | 11 |
| AD-1570980.1 | 82 | 13 | 81 | 14 | 92 | 9 |
| AD-1555428.1 | 48 | 12 | 75 | 8 | 96 | 4 |
| AD-1555429.1 | 47 | 7 | 66 | 8 | 90 | 4 |
| AD-1570981.1 | 34 | 14 | 66 | 3 | 92 | 6 |
| AD-1555535.1 | 41 | 2 | 65 | 5 | 71 | 6 |
| AD-1571085.1 | 48 | 6 | 77 | 6 | 69 | 8 |
| AD-1555537.1 | 52 | 1 | 63 | 4 | 115 | 12 |
| AD-1571086.1 | 40 | 2 | 54 | 6 | 61 | 3 |
| AD-1571087.1 | 69 | 15 | 76 | 4 | 97 | 13 |
| AD-1571088.1 | 39 | 7 | 63 | 8 | 60 | 7 |
| AD-1555546.1 | 20 | 4 | 30 | 4 | 56 | 7 |
| AD-1555547.1 | 24 | 3 | 47 | 4 | 73 | 11 |
| AD-1555548.1 | 41 | 5 | 55 | 5 | 79 | 7 |
| AD-1555549.1 | 61 | 10 | 89 | 7 | 84 | 11 |
| AD-1555550.1 | 35 | 5 | 60 | 9 | 95 | 12 |
| AD-1570982.1 | 55 | 1 | 80 | 11 | 95 | 11 |
| AD-1570983.1 | 61 | 5 | 84 | 10 | 100 | 13 |
| AD-1555583.1 | 40 | 4 | 65 | 3 | 89 | 9 |
| AD-1555584.1 | 50 | 5 | 78 | 11 | 102 | 8 |
| AD-1555585.1 | 49 | 4 | 74 | 13 | 86 | 9 |
| AD-1555586.1 | 48 | 11 | 70 | 5 | 86 | 18 |
| AD-1555587.1 | 34 | 9 | 60 | 6 | 89 | 11 |
| AD-1555588.1 | 40 | 7 | 56 | 7 | 91 | 10 |
| AD-1555589.1 | 34 | 3 | 52 | 11 | 83 | 13 |

TABLE 8-continued

Single Dose Screen in Hep3b Cells

| Duplex | 10 nM Avg % message remaining | St. Dev | 1 nM Avg % message remaining | St. Dev | 0.1 nM Avg % message remaining | St. Dev |
|---|---|---|---|---|---|---|
| AD-1571089.1 | 32 | 3 | 42 | 6 | 60 | 3 |
| AD-1555590.1 | 46 | 6 | 68 | 16 | 87 | 5 |
| AD-1571090.1 | 40 | 8 | 54 | 10 | 69 | 12 |
| AD-1571091.1 | 39 | 8 | 52 | 7 | 56 | 7 |
| AD-1570984.1 | 77 | 11 | 100 | 10 | 110 | 8 |
| AD-1571092.1 | 39 | 9 | 76 | 6 | 86 | 16 |
| AD-1571093.1 | 71 | 9 | 76 | 7 | 86 | 10 |
| AD-1571094.1 | 66 | 7 | 73 | 18 | 104 | 13 |
| AD-1570985.1 | 25 | 5 | 43 | 10 | 60 | 4 |
| AD-1555615.1 | 43 | 2 | 60 | 7 | 82 | 12 |
| AD-1555616.1 | 60 | 10 | 84 | 22 | 91 | 9 |
| AD-1571096.1 | 90 | 10 | 95 | 12 | 96 | 14 |
| AD-1555626.1 | 69 | 15 | 67 | 11 | 99 | 11 |
| AD-1570986.1 | 71 | 6 | 90 | 10 | 93 | 5 |
| AD-1555628.1 | 81 | 7 | 85 | 11 | 102 | 15 |
| AD-1570987.1 | 119 | 16 | 99 | 14 | 126 | 8 |
| AD-1570988.1 | 82 | 7 | 96 | 8 | 116 | 10 |
| AD-1571097.1 | 43 | 3 | 65 | 11 | 61 | 6 |
| AD-1555706.1 | 60 | 10 | 78 | 16 | 101 | 18 |
| AD-1570989.1 | 59 | 17 | 83 | 12 | 96 | 12 |
| AD-1555707.1 | 34 | 8 | 57 | 5 | 81 | 9 |
| AD-1570990.1 | 63 | 9 | 67 | 8 | 93 | 9 |
| AD-1571098.1 | 48 | 3 | 73 | 3 | 82 | 10 |
| AD-1555709.1 | 44 | 3 | 72 | 12 | 89 | 14 |
| AD-1571099.1 | 50 | 11 | 79 | 12 | 92 | 7 |
| AD-1571100.1 | 24 | 5 | 44 | 3 | 64 | 10 |
| AD-1555711.1 | 49 | 5 | 78 | 4 | 97 | 15 |
| AD-1570991.1 | 77 | 8 | 122 | 9 | 114 | 11 |
| AD-1570992.1 | 78 | 6 | 127 | 24 | 97 | 12 |
| AD-1570993.1 | 28 | 4 | 51 | 1 | 77 | 6 |
| AD-1570994.1 | 67 | 1 | 85 | 18 | 102 | 11 |
| AD-1555717.1 | 42 | 2 | 57 | 1 | 73 | 8 |
| AD-1555723.1 | 48 | 5 | 70 | 11 | 100 | 13 |
| AD-1555725.1 | 42 | 3 | 71 | 11 | 98 | 17 |
| AD-1570995.1 | 90 | 13 | 110 | 20 | 129 | 15 |
| AD-1571102.1 | 24 | 4 | 37 | 4 | 58 | 5 |
| AD-1570996.1 | 47 | 8 | 87 | 24 | 112 | 13 |
| AD-1571103.1 | 43 | 6 | 68 | 8 | 92 | 14 |
| AD-1555768.1 | 37 | 8 | 66 | 14 | 92 | 18 |
| AD-1570997.1 | 43 | 6 | 85 | 17 | 89 | 20 |
| AD-1570998.1 | 61 | 7 | 91 | 16 | 90 | 23 |
| AD-1555771.1 | 17 | 3 | 34 | 6 | 44 | 5 |
| AD-1555772.1 | 23 | 3 | 43 | 10 | 66 | 17 |
| AD-1555776.1 | 52 | 12 | 82 | 12 | 117 | 23 |
| AD-1570999.1 | 120 | 18 | 120 | 23 | 154 | 33 |
| AD-1571104.1 | 70 | 9 | 56 | 7 | 91 | 16 |
| AD-1571105.1 | 20 | 1 | 40 | 5 | 40 | 5 |
| AD-1571106.1 | 31 | 2 | 47 | 7 | 74 | 14 |
| AD-1571000.1 | 38 | 5 | 94 | 12 | 112 | 16 |
| AD-1571107.1 | 25 | 1 | 52 | 5 | 70 | 6 |
| AD-1555789.1 | 27 | 2 | 55 | 7 | 72 | 9 |
| AD-1571108.1 | 65 | 9 | 87 | 6 | 92 | 21 |
| AD-1555894.1 | 52 | 13 | 65 | 9 | 115 | 5 |
| AD-1555895.1 | 37 | 7 | 58 | 8 | 78 | 17 |
| AD-1571001.1 | 59 | 11 | 96 | 15 | 96 | 16 |
| AD-1571109.1 | 62 | 4 | 83 | 7 | 93 | 10 |
| AD-1555897.1 | 57 | 15 | 88 | 21 | 125 | 13 |
| AD-1571110.1 | 79 | 11 | 109 | 10 | 118 | 10 |
| AD-1555898.1 | 47 | 7 | 87 | 24 | 114 | 24 |
| AD-1555899.1 | 78 | 6 | 109 | 14 | 104 | 4 |
| AD-1571111.1 | 88 | 5 | 95 | 8 | 107 | 17 |
| AD-1555900.1 | 45 | 4 | 99 | 12 | 86 | 5 |
| AD-1571002.1 | 19 | 8 | 61 | 5 | 69 | 6 |
| AD-1571112.1 | 27 | 3 | 50 | 6 | 65 | 11 |
| AD-1571113.1 | 41 | 2 | 64 | 8 | 82 | 16 |
| AD-1571114.1 | 39 | 5 | 62 | 5 | 77 | 15 |
| AD-1571115.1 | 54 | 7 | 70 | 7 | 74 | 13 |
| AD-1571116.1 | 41 | 4 | 70 | 8 | 75 | 13 |
| AD-1571117.1 | 110 | 3 | 108 | 23 | 102 | 14 |
| AD-1556052.1 | 19 | 3 | 42 | 5 | 73 | 17 |
| AD-1571118.1 | 24 | 5 | 60 | 6 | 79 | 3 |
| AD-1571119.1 | 30 | 3 | 55 | 10 | 83 | 13 |
| AD-1571003.1 | 42 | 4 | 87 | 7 | 94 | 11 |
| AD-1571120.1 | 44 | 7 | 58 | 11 | 77 | 15 |
| AD-1556057.1 | 33 | 5 | 69 | 12 | 71 | 7 |
| AD-1571121.1 | 69 | 11 | 77 | 6 | 87 | 8 |
| AD-1571122.1 | 46 | 4 | 62 | 13 | 81 | 19 |
| AD-1571004.1 | 106 | 5 | 115 | 12 | 111 | 10 |
| AD-1571123.1 | 90 | 10 | 103 | 6 | 102 | 9 |
| AD-1556126.1 | 43 | 2 | 103 | 18 | 100 | 16 |
| AD-1571005.1 | 40 | 16 | 99 | 10 | 88 | 10 |
| AD-1556127.1 | 38 | 3 | 75 | 14 | 77 | 7 |
| AD-1571124.1 | 44 | 6 | 84 | 11 | 102 | 15 |
| AD-1571125.1 | 54 | 6 | 95 | 16 | 107 | 19 |
| AD-1571006.1 | 35 | 0 | 76 | 9 | 80 | 2 |
| AD-1571126.1 | 49 | 11 | 70 | 10 | 72 | 12 |
| AD-1556137.1 | 40 | 1 | 85 | 17 | 86 | 3 |
| AD-1571007.1 | 66 | 12 | 117 | 20 | 104 | 14 |
| AD-1571008.1 | 55 | 5 | 101 | 25 | 107 | 8 |
| AD-1556139.1 | 48 | 7 | 84 | 15 | 101 | 21 |
| AD-1571127.1 | 60 | 5 | 76 | 6 | 79 | 8 |
| AD-1571009.1 | 23 | 6 | 76 | 19 | 66 | 8 |
| AD-1571128.1 | 42 | 5 | 71 | 11 | 95 | 15 |
| AD-1571129.1 | 47 | 9 | 71 | 11 | 87 | 18 |
| AD-1556163.1 | 27 | 6 | 81 | 14 | 85 | 11 |
| AD-1571010.1 | 61 | 5 | 94 | 11 | 73 | 5 |
| AD-1556164.1 | 52 | 5 | 41 | 7 | 77 | 2 |
| AD-1556166.1 | 55 | 10 | 88 | 7 | 89 | 14 |
| AD-1556167.1 | 43 | 7 | 93 | 13 | 114 | 8 |
| AD-1571011.1 | 44 | 12 | 99 | 12 | 101 | 14 |
| AD-1571130.1 | 48 | 3 | 82 | 12 | 83 | 15 |
| AD-1571131.1 | 54 | 7 | 78 | 10 | 99 | 21 |
| AD-1556319.1 | 34 | 5 | 47 | 15 | 62 | 9 |
| AD-1571132.1 | 75 | 15 | 100 | 25 | 114 | 14 |
| AD-1571133.1 | 96 | 24 | 110 | 24 | 126 | 31 |
| AD-1571134.1 | 52 | 14 | 87 | 14 | 108 | 10 |
| AD-1571135.1 | 47 | 12 | 65 | 4 | 138 | 37 |
| AD-1571136.1 | 93 | 7 | 105 | 14 | 112 | 13 |
| AD-1556359.1 | 31 | 6 | 36 | 1 | 81 | 0 |
| AD-1571137.1 | 59 | 9 | 81 | 10 | 100 | 13 |
| AD-1556360.1 | 26 | 2 | 49 | 15 | 48 | 12 |
| AD-1571138.1 | 85 | 18 | 93 | 18 | 91 | 16 |
| AD-1571139.1 | 51 | 10 | 92 | 15 | 100 | 24 |
| AD-1556382.1 | 38 | 8 | 63 | 6 | 40 | 8 |
| AD-1571012.1 | 58 | 6 | 71 | 10 | 54 | 15 |
| AD-1556383.1 | 44 | 7 | 81 | 10 | 70 | 22 |
| AD-1571013.1 | 58 | 12 | 90 | 6 | 86 | 10 |
| AD-1571140.1 | 117 | 32 | 120 | 16 | 131 | 16 |
| AD-1556465.1 | 36 | 2 | 70 | 8 | 68 | 2 |
| AD-1556466.1 | 8 | 2 | 24 | 4 | 41 | 3 |
| AD-1571141.1 | 52 | 11 | 88 | 15 | 97 | 12 |
| AD-1571014.1 | 63 | 13 | 45 | 10 | 91 | 24 |
| AD-1571015.1 | 49 | 6 | 83 | 9 | 80 | 19 |
| AD-1571016.1 | 47 | 4 | 67 | 1 | 59 | 7 |
| AD-1571017.1 | 55 | 5 | 90 | 13 | 90 | 14 |
| AD-1556484.1 | 49 | 13 | 87 | 2 | 79 | 16 |
| AD-1571142.1 | 84 | 11 | 94 | 20 | 97 | 11 |
| AD-1571018.1 | 48 | 9 | 83 | 10 | 94 | 16 |
| AD-1571143.1 | 49 | 5 | 73 | 12 | 95 | 5 |
| AD-1556510.1 | 34 | 6 | 57 | 3 | 68 | 10 |
| AD-1571144.1 | 28 | 7 | 53 | 10 | 74 | 9 |
| AD-1571019.1 | 28 | 2 | 54 | 2 | 75 | 9 |
| AD-1571145.1 | 38 | 7 | 51 | 4 | 77 | 8 |
| AD-1571146.1 | 39 | 3 | 63 | 3 | 81 | 11 |
| AD-1571147.1 | 38 | 6 | 48 | 9 | 77 | 5 |
| AD-1571148.1 | 25 | 1 | 46 | 6 | 68 | 4 |
| AD-1571149.1 | 59 | 7 | 68 | 8 | 72 | 5 |
| AD-1571150.1 | 41 | 11 | 65 | 8 | 88 | 5 |
| AD-1571151.1 | 59 | 1 | 74 | 13 | 94 | 13 |

TABLE 8-continued

Single Dose Screen in Hep3b Cells

| | 10 nM | | 1 nM | | 0.1 nM | |
|---|---|---|---|---|---|---|
| Duplex | Avg % message remaining | St. Dev | Avg % message remaining | St. Dev | Avg % message remaining | St. Dev |
| AD-1556584.1 | 67 | 5 | 102 | 17 | 89 | 17 |
| AD-1556585.1 | 54 | 3 | 92 | 17 | 91 | 21 |
| AD-1571020.1 | 86 | 13 | 118 | 16 | 114 | 9 |
| AD-1556586.1 | 57 | 7 | 93 | 3 | 103 | 13 |
| AD-1556587.1 | 47 | 8 | 75 | 9 | 94 | 7 |
| AD-1571021.1 | 72 | 1 | 95 | 4 | 117 | 8 |
| AD-1571022.1 | 47 | 3 | 84 | 8 | 97 | 8 |
| AD-1556613.1 | 48 | 9 | 62 | 7 | 88 | 12 |
| AD-1571152.1 | 52 | 4 | 67 | 8 | 92 | 13 |
| AD-1556677.1 | 40 | 5 | 80 | 18 | 94 | 12 |
| AD-1556709.1 | 66 | 16 | 92 | 5 | 91 | 9 |
| AD-1571023.1 | 56 | 8 | 94 | 13 | 85 | 10 |
| AD-1556710.1 | 51 | 6 | 69 | 9 | 91 | 12 |
| AD-1556789.1 | 57 | 4 | 97 | 5 | 93 | 12 |
| AD-1556790.1 | 75 | 5 | 113 | 21 | 107 | 13 |
| AD-1556791.1 | 77 | 13 | 101 | 22 | 99 | 19 |
| AD-1571153.1 | 53 | 9 | 65 | 9 | 95 | 11 |
| AD-1556795.1 | 43 | 4 | 82 | 5 | 99 | 17 |
| AD-1556799.1 | 64 | 3 | 87 | 11 | 104 | 7 |
| AD-1571024.1 | 85 | 11 | 113 | 13 | 115 | 7 |
| AD-1556802.1 | 62 | 10 | 95 | 14 | 92 | 14 |
| AD-1571154.1 | 47 | 6 | 67 | 7 | 96 | 7 |
| AD-1556908.1 | 37 | 5 | 82 | 10 | 93 | 11 |
| AD-1556909.1 | 70 | 16 | 101 | 11 | 114 | 24 |
| AD-1556911.1 | 20 | 1 | 39 | 3 | 42 | 8 |
| AD-1571155.1 | 11 | 3 | 24 | 3 | 45 | 6 |
| AD-1571156.1 | 8 | 1 | | 0 | | |
| AD-1571025.1 | 40 | 8 | 49 | 4 | 56 | 8 |
| AD-1556915.1 | 29 | 8 | 37 | 8 | 58 | 12 |
| AD-1556917.1 | 22 | 4 | 39 | 6 | 55 | 9 |
| AD-1571026.1 | 30 | 6 | 52 | 6 | 57 | 12 |
| AD-1556918.1 | 18 | 4 | 33 | 9 | 46 | 5 |
| AD-1571027.1 | 45 | 4 | 66 | 6 | 86 | 3 |
| AD-1571157.1 | 18 | 7 | 37 | 8 | 57 | 10 |
| AD-1571158.1 | 10 | 2 | 17 | 3 | 20 | 5 |
| AD-1571159.1 | 18 | 0 | 22 | 5 | 42 | 4 |
| AD-1571160.1 | 16 | 1 | 26 | 4 | 35 | 5 |
| AD-1571161.1 | 27 | 3 | 31 | 10 | 55 | 12 |

Example 3

In Vivo Efficacy of dsRNA Duplexes in Non-Human Primates (NHP)

Selected duplexes of interest, identified from the above in vitro studies, were evaluated in vivo in non-human primates. FIG. 1 provides a depiction of the study design.

In particular, 15 male Cynomolgus monkeys were divided into 5 groups of 3 each and were subcutaneously administered a single 3 mg/kg dose of AD-1556360, a single 10 mg/kg dose of AD-1556360, a single 3 mg/kg dose of AD-1571158, or a single 3 mg/kg dose of AD-1571033, or PBS as a control (see Table 9). For each animal, two liver biopsy samples (one per lobe) of about 100 mg each were collected following 12 hours of fasting on Day 22, Day 57, and/or Day 85. Liver biopsy and serum samples were also collected from the animals 21 days prior to dosing. One mL of blood was collected into tubes without anticoagulant weekly from Day 1 for hepcidin level, iron level, transferrin saturation level, and red blood cell (RBC) count determinations. Following clotting, serum was aliquoted and stored at −80° C.

Tissue mRNA was extracted and analyzed by the RT-QPCR method. TMPRSS6 mRNA levels were compared to the levels of the housekeeping gene, GAPDH. The values were then normalized to the average of PBS vehicle control group. The data were expressed as percent of baseline value, and presented as mean plus standard deviation.

Iron and transferrin saturation levels were determined using commercially available kits from Roche.

Figure 2:
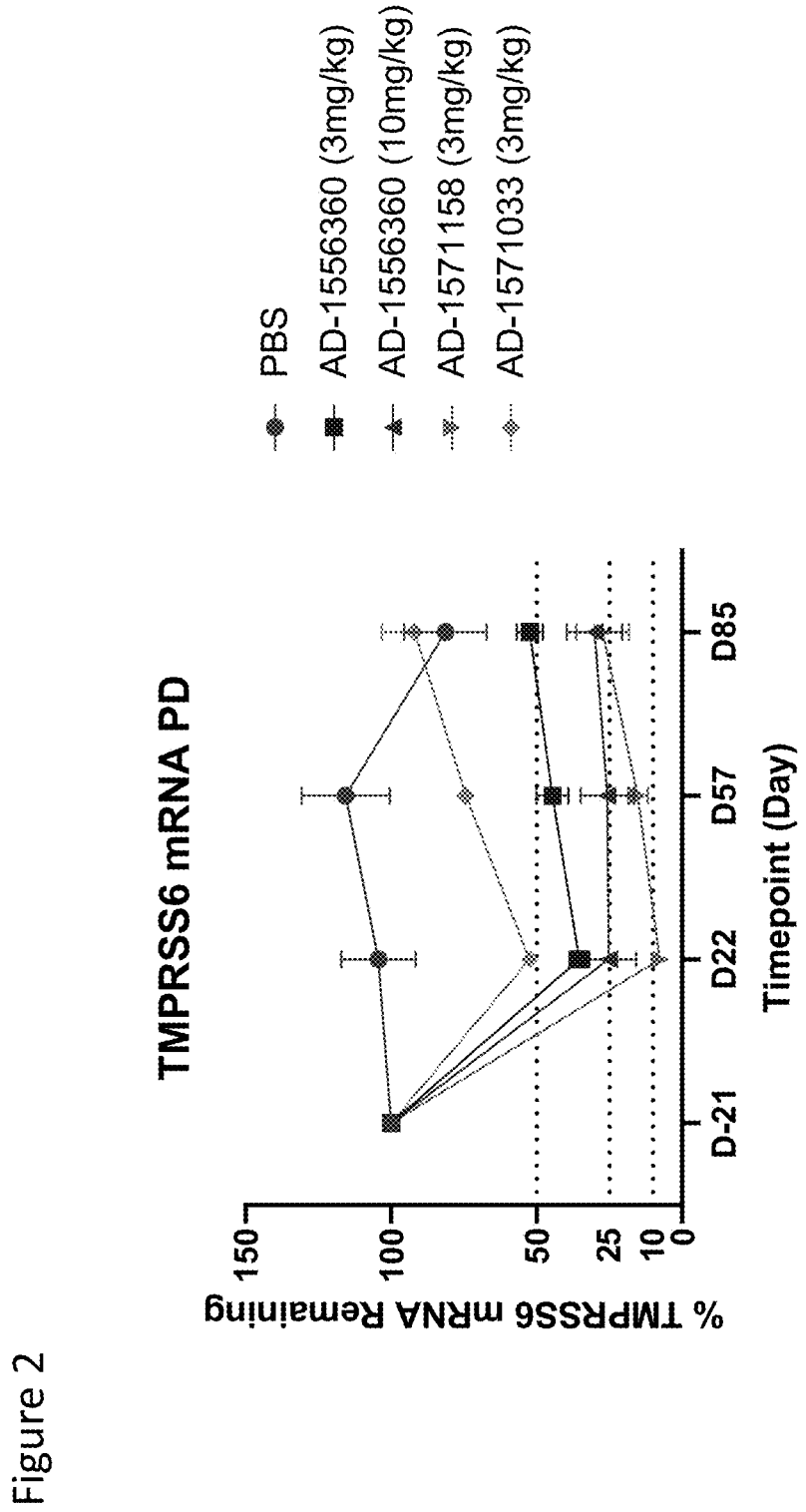
FIG. 2 is a graph showing the percent of serum TMPRSS6 mRNA remaining in Cynomolgous monkeys (n=3 per group) subcutaneously administered a single 3 mg/kg or 10 mg/kg dose of the indicated dsRNA duplexes at Days 21, 22, 57, and 85 post-dose. TMPRSS6 mRNA levels are shown relative to control levels obtained from Cynomolgous monkeys administered PBS as a control.
Figure 3:
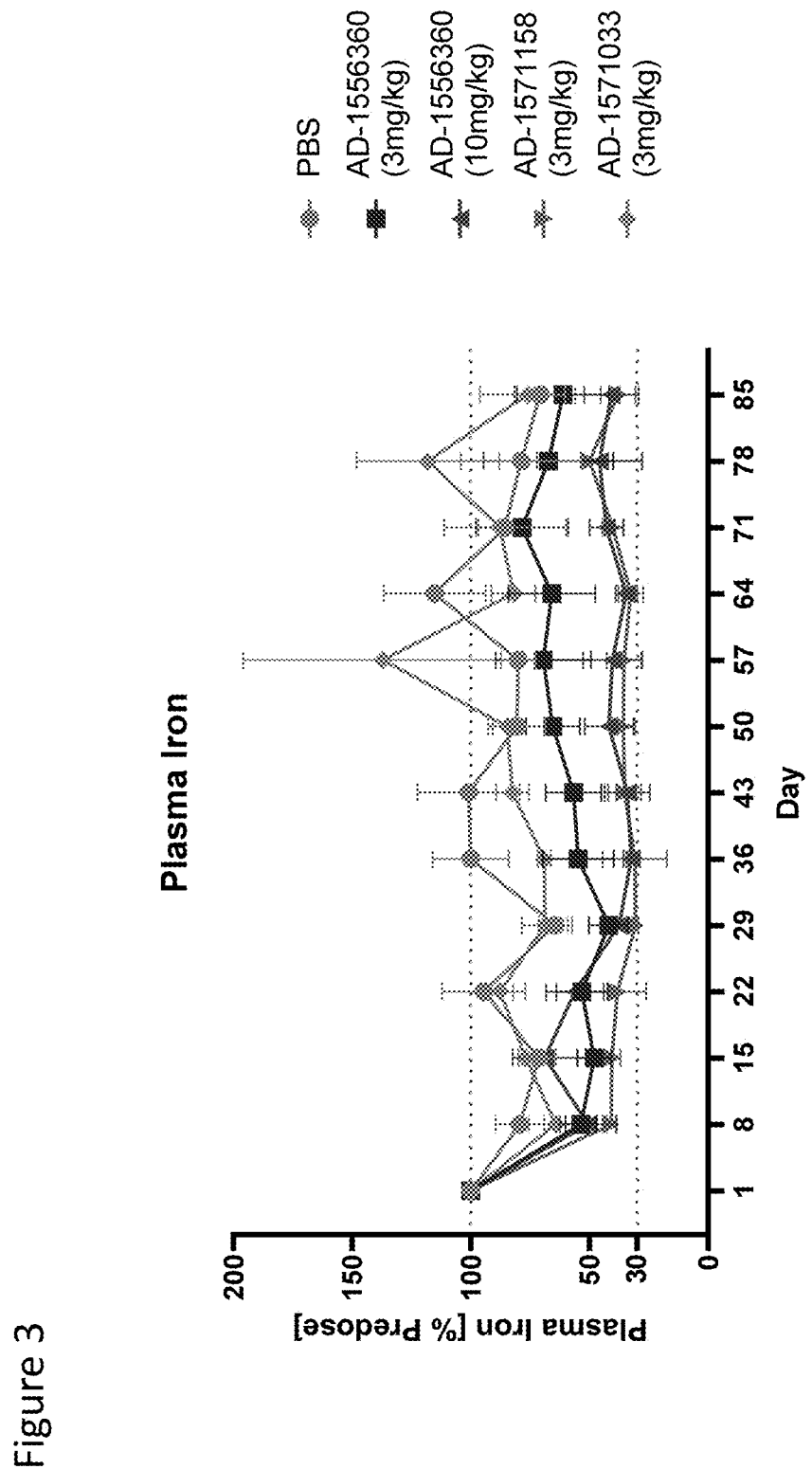
FIG. 3 is a graph showing the plasma iron levels, as a percent of predose levels, in Cynomolgous monkeys (n=3 per group) subcutaneously administered a single 3 mg/kg or 10 mg/kg dose of the indicated dsRNA duplexes at Days 1, 8, 15, 22, 29, 36, 43, 50, 57, 64, 71, 78, and 85 post-dose.
Figure 4:
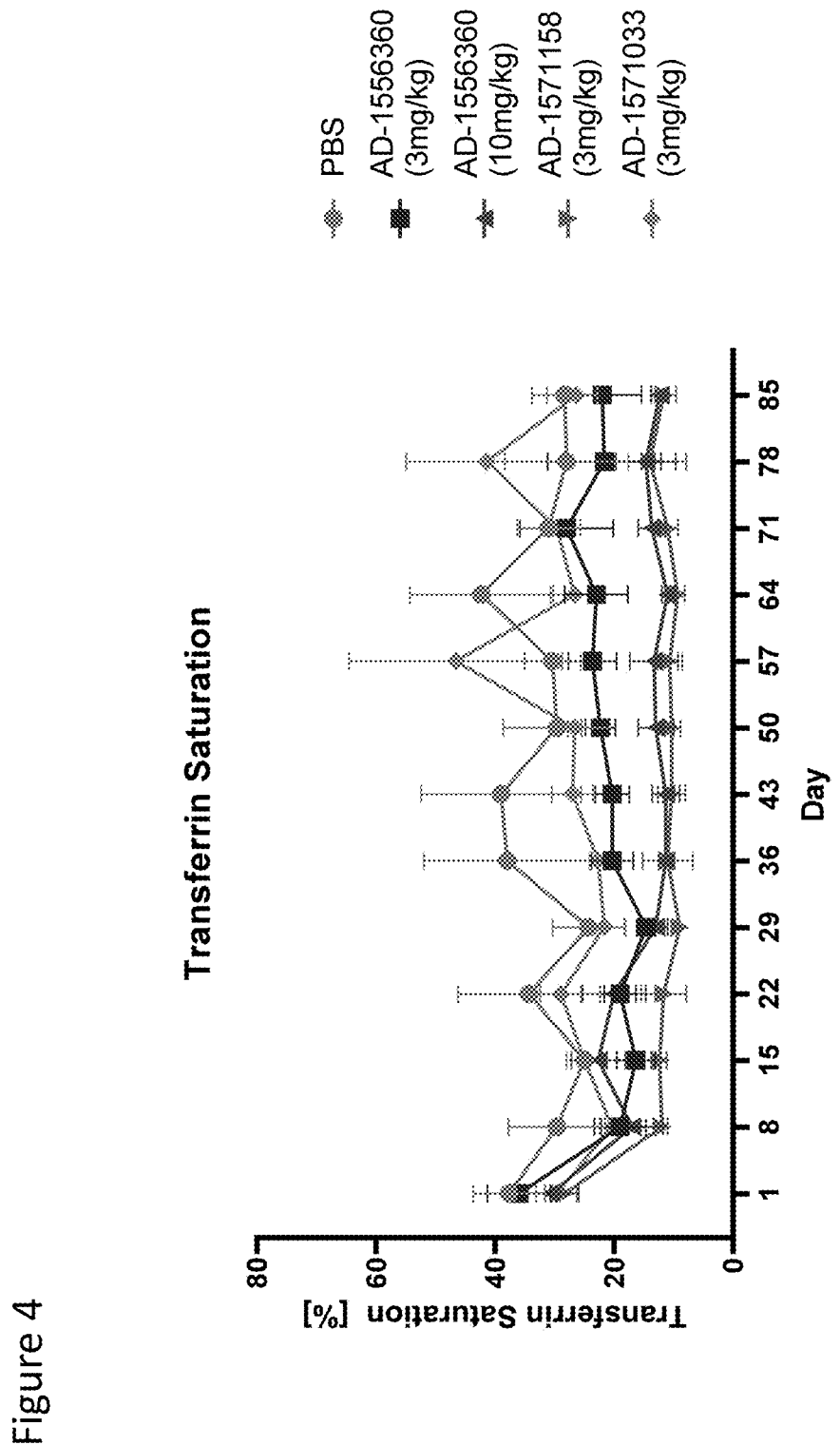
FIG. 4 is a graph showing the percent transferrin saturation levels in Cynomolgous monkeys (n=3 per group) subcutaneously administered a single 3 mg/kg or 10 mg/kg dose of the indicated dsRNA duplexes at Days 1, 8, 15, 22, 29, 36, 43, 50, 57, 64, 71, 78, and 85 post-dose.

The results, shown in FIGS. 2-4, demonstrate that all three exemplary duplexes, AD-1556360, AD-1571158, and AD-1571033, potently and durably inhibit the expression of TMPRSS6 messenger RNA in vivo (FIG. 2), potently and durably lower plasma iron levels (FIG. 3), and potently and durably lower transferrin saturation levels (FIG. 4). Transferrin saturation is a measure of the amount of iron bound to serum transferrin, and corresponds to the ratio of serum iron and total iron-binding capacity.

TABLE 9

Treatment Groups

| Group No. | Duplex | Dose Level (mg/kg) | No. of males |
|---|---|---|---|
| 1 | PBS (control) | 0 | 3 |
| 2 | AD-1556360 | 3 | 3 |
| 3 | AD-1556360 | 10 | 3 |
| 4 | AD-1571158 | 3 | 3 |
| 5 | AD-1571033 (benchmark comparator duplex) | 3 | 3 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (2333 sequences)

SEQ ID NO: 1 - DNA, 3197 bp, Homo sapiens
  source 1..3197: mol_type = unassigned DNA
gttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatccaa

SEQ ID NO: 2 - DNA, 3197 bp, Homo sapiens
  source 1..3197: mol_type = unassigned DNA
ttggatcaggcagctttattccaaagggcagctgagctcacctcccagtgagggtctgggctgtgagggcccaggtggcaggcaggggtggggcaaggaccctggagtcaggacttccccaccttttggcttacagtggcagcaggcccacctggcagtctccagggctctgagggtcccctccgatgggagcaccttccattcccagatcccaagttagaccaggggcttccgaagctggaatctgctctctggaggcaaggctgcccaaacagcctctgtacagagtggggcgcacctcagacactcctcgggatgtagaaccagcattcttgctgctgagccactgccttgcattaggcagcagtggaggaaggggacggaggagagagaattgggaggcagaagggctgggtgtgggcctgggtcctcaggggacgtcttgacccccagctgctggcacttctccatcctcctgccatcactggagcagacatcagggacgagacaagatgccacctcctgccaccacagggcctgctctctcccccaccccccgccagaatacttgtccccctgcttggcagttgccctgggctctctgagtccaggaggtgggccctgctttgcaggggggcagttcctcaggtcaccacttgctggatccagctgatcacacctgtgatgcgggtgtagacgccgaagtagttaggccggccacagcccaggccccagctgaccagccccgccaggaaccagcggccactgagtgccttgcacaccagcggaccacctgagtcaccctgacaggcatccttcttgcccttgcggtagccggcacacagcatgcgtggcgtcacctggtagcgatagacctcgctgcacaggtcctgtgggatcaactgcacatccactttctgcagagcgttgctgatggggccgccctcgcgcaaggcgccccagcccgtaatccagcagtgcaggccgggctcgaagaagtgggagcgcgcgggcaggcagacggggcgcacggcggccgagcgcaccaccgggtggtcgagctgcagcagcgccacgtcgtagtcatggctgtcctcttcgtggtacgggtgcaggagcaggcggctcaccttgaaggacacctctccaggccagcgcgagttctgccacaccttgcccaggaacacggtccacagcaccgtggaggccatgctgtcctcctggaagcagtgggcagctgttatcacccagcggtcagcgatgagggcccccccacagatgtgtcgaccccgaacctggaggctggcctgccatggccactcaccctcggaggacacagctccaccaacaatgcggctggaggggccctggaggccacagtcacagtgctcctcatccgagccgtccctgcagtcgggccgcccatcacactgcgggttgggcttcttcacgcagctccggtcctcacactggaaggtgaatgtcccacatggcaccccttcctggcactgctcttcgtcgctgccgttgagacaatcaggctgcccatcacagaccttgggcagtgagatgcatgtgctgtcctctttgcactggaatgtggctctgcaaacgcagtttctctcatccaggccgttggggcagtccttgaccccatcacaggcagggacacagagtccattcacagaacagaggaactctccagggcaggggtccgactggttgtacaagccatagtgcacccgcacaccgggcccggtgagggagatctgggaggtgaagttgatggtgatcccggccgtggccaccacggggatcctctcggcgtagggctgcaggatgcgcaagccacacagcctcctgttctggatcgtccactggccctgggtgcacggcaaatcatacttctgcctcctcagtgcataggcatcaaaccagagggccaagccgtagtccagagagggcaccgtgaggtgccaggagcagtgggtttggggcgagtagtagctggggaagtacggggtgctgaggacgccctgggagtcgagcctgttgtccagcgtcaggttcacttcacaggcctggaagaccaccggctgcacggagagcacgaaggggtcgtagtagctgtgcaggcccttcttccagacgaccgccatgatggcccccgacgccagaacctccaccacgggctcctggcggctgcagccgtacaccgaggtgatgagcctcttctccaggggcccggccacgtcatacatggccagtcggtcccggcactctgccagcgtccactccagccggagtttgagcatgaggtccttggggccctgcaggtgccacaggcagctggaggccaggtggtcaggccccttcagccggaggacctggccctggcccacgtagctgtagcggtaacaacccagcgtggaattcaatgcagctatgtctttcacactggcttccaggatcactaggccctcggggtccacttcgtactcggccctgtaggggacggcagccgagctgttgactgtggacagcagctcctccaccagcagtgcctgcaccacctcggggctcagcatcagccggcggtgctcggggatttggagaatgaaccagaagaagcaggtgaggggtccctccccaaaggaatagacggagctggagttgtagtaagttcccaggcgggtgctggtgatgagctccttgagcatcttctgggctttggcggtttcactgcggaaggcactagattcccggcgggtaagatcctgggagaagtggcgattgagtacacgcagactgcctgagtacacctggctgaccatcacctccgccttgtaccctaggaaataccagagtagcacccccgccgaagccagcacgagcagggccagcagcacaaacaggggcaccaggcggaggtagccccgggcttttctcttggagtcctcacaggccttgaacatcccctccggctccgcttcctcgccatcacctccgtccccctgcccgccagccacctggggggcctcggccacgggcatccttttggagtggaagagtaacaacatcaggcggcagtgactgcaagtgggtgccgagacagctcacagaggagggaagtgcatctcaggtcagctcgcaccagagggcaggcaccagagctggactgggtctggctcaagaac

SEQ ID NO: 3 - DNA, 3206 bp, Mus musculus
  source 1..3206: mol_type = unassigned DNA
agtttcattgtcgccctggacctgacaggagaggcccatggaacttggggccacaggccacaagggacaagggccagacaccccagccatggctccaggccattgatccaacctaagctggccagttgggggtggaaagaccttggcctggataaacagaggcctccaggcctgtgtgcaggcccggcacctaccttccactcttgaagatgccgagatgtttccagctcccctgttctaccaggatgcccaccaccgaggtcccccaagcggctgatggtcagggcgatgcgggtgatggagaggaagctgctgagccagaggggaagttcaagcccccaaaaaacaccaagagaaaaaaccgggactacgtccgcttcacgccactgttgctggtcttggctgcgctggtctcagcaggggtcatgctttggtatttcctagggtacaaagcggaagtgaccgtaagccaggtgtactctggcagcctccgggtgctcaaccgtcatttctcccaggacctgggccgacgggagtctattgctttccgcagtgaatctgccaaagcccagaagatgctccaagaactggttgccagcacccgcctgggtacttactacaactctagttctgtctactcctttggggagggacccctcacctgcttcttctggtttatccttgacatccctgagtaccagcgactgaccctgagccctgaagtagtgcgcgagctcctggtggatgagctactgtccaacagctcaaccctggcttcctataagaccgaatatgaggtggacccggaaggcctggtgatcctggaagccagtgtgaacgacatagtcgtactgaattccacgctgggctgttatcgctacagctatgtgaacccaggccaggtcctcccattgaaggggcctgaccagcagaccacaagctgcctgtggcatctgcaagggcccgaagacctcatgatcaaagtgcggctggagtggacccgggtcgattgcagagacagggtggcgatgtacgacgcagctgggcccctggagaagagacttatcacctcggtctatgggtgcagccgccaggaacctgtgatggaggtgctggcatcgggctccgtcatggccgtggtgtggaaaaagggcatgcatagctactatgaccctttcctgctctcagtgaagtctgtggccttccaggactgccaggtgaacctgacactggagggccggctggacacacagggcttcctccgtacaccctactaccccagttactactctcccagtacccactgctcctggcatctcacggtaccctctctggactacggcttggcgctctggttcgatgcctacgcactgaggaggcagaagtacaaccgactgtgtactcagggccagtggatgatccagaacaggaggctgtgtggcttccgtaccctgcagccatatgctgagaggatccccatggtggcctcagatggtgtcaccatcaacttcacctcccagatctccctcacaggcccgggtgtgcaagtgtactacagcttgtacaaccaatcagacccctgccctggtgagttcctctgctctgtgaatggactgtgtgtccctgcgtgtgacgggatcaaggactgccccaatggcctggatgagagaaactgtgtctgcagagccatgttccagtgccaagaggacagcacgtgcatttcactgcctagagtctgtgaccggcagcccgactgtctcaatggcagtgacgaagaacagtgccaagaaggagtgccctgtgggacattcactttccagtgtgaggaccggagctgtgtgaagaagcccaacccagagtgtgacggccagtcagattgcagagacggctcagatgagcaacactgtgactgtggcctccagggcctctccagccgtattgtgggcgggaccgtgtcctccgagggtgagtggccatggcaggccagcctccagattcggggtcgacacatctgtgggggggctctcatcgctgaccgctgggtcataacggccgcccactgcttccaggaggacagcatggcctccccgaagctgtggaccgtgttcctgggaaagatgcggcagaactcgcgctggccaggcgaggtgtccttcaaggtgagccgtctgttcctgcacccgtaccacgaggaggacagccatgactacgacgtggccctgctgcagctcgaccaccccgtggtgtactcggccactgtgcgccccgtctgcctgcctgcccgctcccacttctttgagccaggccagcactgctggatcacaggctggggagcccagcgagagggtggtccggtgagcaacaccctgcagaaggtggacgtacagctggtccctcaggacctctgcagtgaggcctaccgctaccaggtgtccccacgcatgctctgtgctggctaccgcaagggcaagaaagatgcctgccagggtgactctggaggcccactggtttgcagggagcccagtggccgctggttcctggcagggttggttagctggggcctgggctgtggccgacccaatttctttggcgtctacacccgtgtcacacgtgtgatcaactggatccagcaggtgctgacctgagggctgttctacagagctggacctgcctccaggccaagttcagggtgtccacccagccaggacacaagtattctggggcaagtgaccctgctaaggcctgtttccctcaggcctaccccagtgacagtacagagaaggatgtcagctggtggttaggatgcctcctgaggtccaggggccagcctcggctaggtttcacttctaaccctttcttattctagtcctttcccctccctgctcctaccactgttttggagtggggtctggcggccatgaccttggcctccgggtctctgtaggaaagaaagaatccttccccttgcaaaagcctcttgggggaactgcacagagaaagaaggtgcctctatcaaggctctatcagagcccttgagtctgccaagtgggctgtactctaagccaaatcaccgggcagcctcagctgcagatgcctgctgaagctctgcctgctacaggggcctccctgccattcactggaggcccactgtctgttctgggaataaagcacttgaccaagccctgacactgaaaaaaaaaaaaaaa

SEQ ID NO: 4 - DNA, 3152 bp, Mus musculus
  source 1..3152: mol_type = unassigned DNA
gacagtgggcctccagtgaatggcagggaggcccctgtagcaggcagagcttcagcaggcatctgcagctgaggctgcccggtgatttggcttagagtacagcccacttggcagactcaagggctctgatagagccttgatagaggcaccttctttctctgtgcagttcccccaagaggcttttgcaaggggaaggattctttctttcctacagagacccggaggccaaggtcatggccgccagaccccactccaaaacagtggtaggagcagggaggggaaaggactagaataagaaagggttagaagtgaaacctagccgaggctggcccctggacctcaggaggcatcctaaccaccagctgacatccttctctgtactgtcactggggtaggcctgagggaaacaggccttagcagggtcacttgccccagaatacttgtgtcctggctgggtggacaccctgaacttggcctggaggcaggtccagctctgtagaacagccctcaggtcagcacctgctggatccagttgatcacacgtgtgacacgggtgtagacgccaaagaaattgggtcggccacagcccaggccccagctaaccaaccctgccaggaaccagcggccactgggctccctgcaaaccagtgggcctccagagtcaccctggcaggcatctttcttgcccttgcggtagccagcacagagcatgcgtggggacacctggtagcggtaggcctcactgcagaggtcctgagggaccagctgtacgtccaccttctgcagggtgttgctcaccggaccaccctctcgctgggctccccagcctgtgatccagcagtgctggcctggctcaaagaagtgggagcgggcaggcaggcagacggggcgcacagtggccgagtacaccacggggtggtcgagctgcagcagggccacgtcgtagtcatggctgtcctcctcgtggtacgggtgcaggaacagacggctcaccttgaaggacacctcgcctggccagcgcgagttctgccgcatctttcccaggaacacggtccacagcttcggggaggccatgctgtcctcctggaagcagtgggcggccgttatgacccagcggtcagcgatgagagcccccccacagatgtgtcgaccccgaatctggaggctggcctgccatggccactcaccctcggaggacacggtcccgcccacaatacggctggagaggccctggaggccacagtcacagtgttgctcatctgagccgtctctgcaatctgactggccgtcacactctgggttgggcttcttcacacagctccggtcctcacactggaaagtgaatgtcccacagggcactccttcttggcactgttcttcgtcactgccattgagacagtcgggctgccggtcacagactctaggcagtgaaatgcacgtgctgtcctcttggcactggaacatggctctgcagacacagtttctctcatccaggccattggggcagtccttgatcccgtcacacgcagggacacacagtccattcacagagcagaggaactcaccagggcaggggtctgattggttgtacaagctgtagtacacttgcacacccgggcctgtgagggagatctgggaggtgaagttgatggtgacaccatctgaggccaccatggggatcctctcagcatatggctgcagggtacggaagccacacagcctcctgttctggatcatccactggccctgagtacacagtcggttgtacttctgcctcctcagtgcgtaggcatcgaaccagagcgccaagccgtagtccagagagggtaccgtgagatgccaggagcagtgggtactgggagagtagtaactggggtagtagggtgtacggaggaagccctgtgtgtccagccggccctccagtgtcaggttcacctggcagtcctggaaggccacagacttcactgagagcaggaaagggtcatagtagctatgcatgccctttttccacaccacggccatgacggagcccgatgccagcacctccatcacaggttcctggcggctgcacccatagaccgaggtgataagtctcttctccaggggcccagctgcgtcgtacatcgccaccctgtctctgcaatcgacccgggtccactccagccgcactttgatcatgaggtcttcgggcccttgcagatgccacaggcagcttgtggtctgctggtcaggccccttcaatgggaggacctggcctgggttcacatagctgtagcgataacagcccagcgtggaattcagtacgactatgtcgttcacactggcttccaggatcaccaggccttccgggtccacctcatattcggtcttataggaagccagggttgagctgttggacagtagctcatccaccaggagctcgcgcactacttcagggctcagggtcagtcgctggtactcagggatgtcaaggataaaccagaagaagcaggtgaggggtccctccccaaaggagtagacagaactagagttgtagtaagtacccaggcgggtgctggcaaccagttcttggagcatcttctgggctttggcagattcactgcggaaagcaatagactcccgtcggcccaggtcctgggagaaatgacggttgagcacccggaggctgccagagtacacctggcttacggtcacttccgctttgtaccctaggaaataccaaagcatgacccctgctgagaccagcgcagccaagaccagcaacagtggcgtgaagcggacgtagtcccggttttttctcttggtgttttttgggggcttgaacttcccctctggctcagcagcttcctctccatcacccgcatcgccctgaccatcagccgcttgggggacctcggtggtgggcatcctggtagaacaggggagctggaaacatctcggcatcttcaagagtggaaggtaggtgccgggcctgcacacaggcctggaggcctctgtttatccaggccaaggtctttccacccccaactggccagcttaggttggatcaatggcctggagccatggctggggtgtctggcccttgtcccttgtggcctgtggccccaagttccatgggcctctcctgtcaggtccagggcgacaatgaaact

SEQ ID NO: 5 - DNA, 2999 bp, Rattus norvegicus
  source 1..2999: mol_type = unassigned DNA
attgtccgtcctggacctgacaggaggcccatggaacttggggccacaggccacgagggacaagggccagacaccccagtcatggttccaggctattgatccaacctaagctggccagttgtgggtggagagaccttggcctggataaacagaggcctccaggcctgtgttcaggcccagcacctaccttccactcttgaagatgccaagatgtttccagctcccctgttctaccaggatgcccaccgctgaggttccccaagcagctggtggtcagggtgatggaggtgatggagaggaagctgcagagccagagggggtgttcaaggcccccagaaacgccaagagaaaagacagggactacgtccgcttcacaccactgttgctggtcttggctgcgttggcttcggcaggagtcatgctctggtatttcctagggtacaaggcggaagtgaccataagccaggtgtactctggcagcctccgggtgctcaaccgccatttttcacaggacttggcccgacgggagtctattgctttccgcactgaaactgccaaagcccagaagatgttccaagagctggttgccagcacccgcttgggtacttactacaactccagttccatctacgcctttggggagggaccccttatctgcttcttctggttcatccttgacatccccgagtaccagcgactgaccctgagccctgaggtggtgcgcgagctcctggtgggtgagctactgtccaacagctcagccttggcttcctataggaccgaatatgaggtggacccggaaggcctggtgatactagaagccagcgtgaacgacatagtcgtactgaattccacgctgggctgttaccgctacagctacgtgaacccgggccaggtcctccggttgagggggcccgaccagcagaccactagctgcctgtggcacctgcaggggcccgaggacctcatgctcaaagtgcagctagagtggactcgggttgattgcagagacagggtggcgatgtacgacgcagctgggcccctggagaagagacttatcacctcggtctatgggtgcagccgccaggaacccgtgatggaggtgctggcgtcgggctctgtcatggccgtggtgtggaagaagggcttgcatagcttctatgacccttttctgctctcagtgaagtctgtggccttccaggactgccaggtgaacctgaccctggaaggccggctggatccacagggcttcctccgtacaccctactaccccagttactactcgcccagtacccactgctcctggcatctcacggttccctctctggactatggcttggcactctggtttgacgcctatgcactgaggaggcagaagtacaacctactatgtactcagggccagtggatgatccagaacaggaggctatgtggcttccgtaccctgcagccatatgctgagaggatccccgtggtggcctcggatggtatcaccatcaacttcacctcccagatctccctcacaggcccgggtgtgcaagtgtactacagcttgtacaaccaatcagacccctgccctggagagttcctctgctctgtgaatggattgtgtgtccctgcttgtgacggaatcaaggactgccccaacggcctggatgagaggaactgtgtctgcagagccatgttccagtgccaagaggacagcacgtgcatctcactgccgagagtctgtgaccggcagcccgactgtctcaatggtagcgacgaagagcagtgccaagaaggagtgccctgtgggacattcactttccagtgtgaggaccggagctgtgtgaagaagcccaaccccgagtgtgacgggcaggcagactgcagggatggctcggatgaggagcactgtgactgtggcctccagggcccctccagccgcattgtgggcggggccatgtcctcggagggtgagtggccctggcaggccagtctccagattcggggtcgacacatctgtgggggggctctcatcgctgaccgctgggtcataacagccgctcactgcttccaggaggacagcatggcctccccgaggctgtggaccgtgtttctgggaaagatgcggcagaattcacgctggccgggcgaggtgtccttcaaggtgagccgcctgttcctgcacccgtatcatgaggaggacagccatgactacgacgtggccctgctgcagctggaccaccctgtggtgtactcggccaccgtgcgccccgtctgcctgcccgcacgctctcacttctttgagccaggccagcactgctggatcacaggctggggagcccagcgagagggtggtcctggtagcagcacccttcagaaggtggatgtgcaactgatccctcaggacctgtgcaatgaggcctaccgttaccaggtgaccccacgcatgctctgtgctggttatcgcaagggcaagaaagatgcctgccagggcgactctggaggcccactggtttgcaaggagcccaggtgaccacccagccagggcacaagtattctggggcgagcgaccctgctaaggcctgtcccctcatgcctaccccagggacagtacagagaaggatgtcagctggtggttaggatgcctccaggggctagcctcagctcggcttcacttccaaccctttcttattctagtcctttcccctctcccctcctactgctgttttggggtggggtctggtggcaatgatgctggttccaaggtctgtgggaaagtaagattccttccccttgcaaaagcctctagggggaactggatccgagaaagaaggtgcctctatcaaggctctgtcagagcccttgagactgccaagtagggccataccgtaagccaaatcatggggcagcctcagctgcgggtgcctgctgtgctctgcctgctacagggccctccctgccattcactggaggcccactgtctgttccggaaataaagcagttggccaagc

SEQ ID NO: 6 - DNA, 2999 bp, Rattus norvegicus
  source 1..2999: mol_type = unassigned DNA
gcttggccaactgctttatttccggaacagacagtgggcctccagtgaatggcagggagggccctgtagcaggcagagcacagcaggcacccgcagctgaggctgccccatgatttggcttacggtatggccctacttggcagtctcaagggctctgacagagccttgatagaggcaccttctttctcggatccagttccccctagaggcttttgcaaggggaaggaatcttactttcccacagaccttggaaccagcatcattgccaccagaccccaccccaaaacagcagtaggaggggagaggggaaaggactagaataagaaagggttggaagtgaagccgagctgaggctagcccctggaggcatcctaaccaccagctgacatccttctctgtactgtccctggggtaggcatgaggggacaggccttagcagggtcgctcgccccagaatacttgtgccctggctgggtggtcacctgggctccttgcaaaccagtgggcctccagagtcgccctggcaggcatctttcttgcccttgcgataaccagcacagagcatgcgtggggtcacctggtaacggtaggcctcattgcacaggtcctgagggatcagttgcacatccaccttctgaagggtgctgctaccaggaccaccctctcgctgggctccccagcctgtgatccagcagtgctggcctggctcaaagaagtgagagcgtgcgggcaggcagacggggcgcacggtggccgagtacaccacagggtggtccagctgcagcagggccacgtcgtagtcatggctgtcctcctcatgatacgggtgcaggaacaggcggctcaccttgaaggacacctcgcccggccagcgtgaattctgccgcatctttcccagaaacacggtccacagcctcggggaggccatgctgtcctcctggaagcagtgagcggctgttatgacccagcggtcagcgatgagagcccccccacagatgtgtcgaccccgaatctggagactggcctgccagggccactcaccctccgaggacatggccccgcccacaatgcggctggaggggccctggaggccacagtcacagtgctcctcatccgagccatccctgcagtctgcctgcccgtcacactcggggttgggcttcttcacacagctccggtcctcacactggaaagtgaatgtcccacagggcactccttcttggcactgctcttcgtcgctaccattgagacagtcgggctgccggtcacagactctcggcagtgagatgcacgtgctgtcctcttggcactggaacatggctctgcagacacagttcctctcatccaggccgttggggcagtccttgattccgtcacaagcagggacacacaatccattcacagagcagaggaactctccagggcaggggtctgattggttgtacaagctgtagtacacttgcacacccgggcctgtgagggagatctgggaggtgaagttgatggtgataccatccgaggccaccacggggatcctctcagcatatggctgcagggtacggaagccacatagcctcctgttctggatcatccactggccctgagtacatagtaggttgtacttctgcctcctcagtgcataggcgtcaaaccagagtgccaagccatagtccagagagggaaccgtgagatgccaggagcagtgggtactgggcgagtagtaactggggtagtagggtgtacggaggaagccctgtggatccagccggccttccagggtcaggttcacctggcagtcctggaaggccacagacttcactgagagcagaaaagggtcatagaagctatgcaagcccttcttccacaccacggccatgacagagcccgacgccagcacctccatcacgggttcctggcggctgcacccatagaccgaggtgataagtctcttctccaggggcccagctgcgtcgtacatcgccaccctgtctctgcaatcaacccgagtccactctagctgcactttgagcatgaggtcctcgggcccctgcaggtgccacaggcagctagtggtctgctggtcgggccccctcaaccggaggacctggcccgggttcacgtagctgtagcggtaacagcccagcgtggaattcagtacgactatgtcgttcacgctggcttctagtatcaccaggccttccgggtccacctcatattcggtcctataggaagccaaggctgagctgttggacagtagctcacccaccaggagctcgcgcaccacctcagggctcagggtcagtcgctggtactcggggatgtcaaggatgaaccagaagaagcagataaggggtccctccccaaaggcgtagatggaactggagttgtagtaagtacccaagcgggtgctggcaaccagctcttggaacatcttctgggctttggcagtttcagtgcggaaagcaatagactcccgtcgggccaagtcctgtgaaaaatggcggttgagcacccggaggctgccagagtacacctggcttatggtcacttccgccttgtaccctaggaaataccagagcatgactcctgccgaagccaacgcagccaagaccagcaacagtggtgtgaagcggacgtagtccctgtcttttctcttggcgtttctgggggccttgaacaccccctctggctctgcagcttcctctccatcacctccatcaccctgaccaccagctgcttggggaacctcagcggtgggcatcctggtagaacaggggagctggaaacatcttggcatcttcaagagtggaaggtaggtgctgggcctgaacacaggcctggaggcctctgtttatccaggccaaggtctctccacccacaactggccagcttaggttggatcaatagcctggaaccatgactggggtgtctggcccttgtccctcgtggcctgtggccccaagttccatgggcctcctgtcaggtccaggacggacaat

SEQ ID NO: 7 - DNA, 3262 bp, Macaca fascicularis
  source 1..3262: mol_type = unassigned DNA
ctcagtcacagtgccgtcctgggcccagcaggaggagccccatggagcctggggccacaggccacaggggacaagggccagacaccctggccatggctctaggccattgatccaggccgggctggcacggtgggggtagggaggccttggcctggacaaacaaaggcttctgaggcctgcgtgcaggcccagcacctatccgccactcccaaaggatgcctgtggccaaggccccccaggtggctggtgggcagggggacggaggtgatggcgaggaagcggagccagaggggatgttcgaggcctgtgaggactccaagagaaaagcccggggctacctccgcctggcgcccctgtggctgaccctggttgtgctgacttcagtgggggtgctactctggtatttcctagggtacaaggcggaggtgacggtcagccaggtgtactcaggcagccttcgcgtgctcaatcgccacttctcccaggatcttacccgccgggaatccagtgccttccgcagtgaaaccgccaaagcccagaagatgctcaaggagctcatcgccagcacccgcctgggaacttattacaactccagctccgtctattcctttggggagggaccgctcacctgcttcttctggttcattctccaaatccccgagcaccgccggctgatgctgagccccgaggtggtgcaggcactgctggtggaggagctgctgtccacagtcaacagctcggcggccgtcccctacagggccgagtacgaagtggaccccgagggcctagtgatcctagaagccagtgtgaaagacatagctgcactgaattccacgctgggttgttaccgctacagctacgtgggccagggtcaggtcctccggctgaagggacccgaccacctggcctccagctgcctgtggcacctgcagggccccgaagacctcatgctgaaactccggctggagtggacgctggccgagtgccgggaccgactggccatgtatgacgtggctgggcccctggagaagaggctcatcacctcggtgtatggctgcagccgccaggagcctgtggtggaagtcctggcatcgggggccatcatggcggtggtctggaagaagggcctgcacagctactacgacccctttatgctctccgtgcagtcggtggtcttccaggcctgcgaggtaaacctgacgctggatgacaggctggactcccagggcgtcctcagcaccccgtacttccccagctactactcgccccgaacccactgctcctggcacctcacggtgccttctctggactacggcttggccctctggtttgacgcctacgcactgcggaggcagaagtatgatttgccgtgcacccagggccagtggacgatccagaacaggaggctgtgtggcctgcgcatcctgcagccttacgctgagaggatccccgtggtggccacggccggcatcaccatcaatttcacctcccagatctccctcacagggcctggtgtgcgggtgcactatggcttgtacaaccagtcggacccctgccctggagagttcctctgctctgtgaacggactctgcgtccctgcctgtgatggggtcaaggactgccccaacggcctggatgagagaaactgcgtttgcagagccacattccagtgccaagaggacagcacgtgcatctcactgcttaaggtctgtgacgggcagcctgactgtctcaacggcagcgatgaagagcggtgccaggaaggggtgccctgcgggacattcaccttccagtgtgaggaccagagctgcgtgaagaagcccaacccacagtgtgatgggcggcccgactgcagggacggctcagacgagcagcactgtgactgtggcctccagggcccctccagtcgcattgttggtggggccgtgtcctccgagggtgagtggccatggcaggccagcctccaggttcggggtcgacacatctgtgggggcgccctcatcgctgaccgctgggtgataacagctgcccattgcttccaggaggacagcatggcctccccggcgctgtggacggtgttcctgggcaaggtgtggcagaactcgcgctggcctggagaggtgtccttcaaggtgagccgcctactcctgcatccgtatcacgaagaggacagccacgactacgacgtggcgctgttgcagctcgaccacccggtggtgcgctcggccgccgtgcgtccagtctgcctgcccgcgcgctcccacttcttcgaacccggcctgcactgctggatcactggctggggcgccctgcgcgaaggcggccccaccagcaatgctctgcagaaagtggacgtgcagttgatcccacaggacctgtgcagcgaggcctatcgctaccaggtgacgccacgcatgctgtgtgccggctaccgcaagggcaagaaggatgcctgccagggtgactcgggtggtccgctggtatgcaaggcactcagtggccgctggttcctggcagggctggtcagctggggcctgggctgtggccgacctaactacttcggcgtctacacccgcatcacaggtgtgatcggctggatccagcaagtggtgacctgaggaactgcccccctgcagagcaggtcccacctcttggactcagagagcccagggcaattgccaagcagggggacaagtattctggggggaggggggcgcgagcaggccctgtggtggcaggaggtggcatcttgtcttgtccctgatgtctgctccagtgatggcaggaggatggaggagtgccagcagctgggggtcaagacgtcccctggggacccaggcccacacccagcccttctgcctcccgattctctctcctccgtccccttcctccactgctgcctattgcaaggaagtggctcagcagcaagaatgctggctctacgtccccaggagtgtctgagctgtgccccgctctgtacagaggctgcttgggcagccttgcctctagagagcagatgccagcttcggaagcccctggtctaacttgggatctgggaatggaaggtgcccccataggaggggaccctcacagccctggggactgccaggtgggccggctgccaccgtaagccaaaaaaggtggggaagccctgactccaaggtccttgccccacccctgcctgccacctggcccctcacagcccagaccctcaccggcaggtgagctcagctgccctttggaataaagctgcctgatccaa

SEQ ID NO: 8 - DNA, 3262 bp, Macaca fascicularis
  source 1..3262: mol_type = unassigned DNA
ttggatcaggcagctttattccaaagggcagctgagctcacctgccggtgagggtctgggctgtgaggggccaggtggcaggcaggggtggggcaaggaccttggagtcagggcttccccaccttttttggcttacggtggcagccggcccacctggcagtccccagggctgtgagggtcccctcctatgggggcaccttccattcccagatcccaagttagaccaggggcttccgaagctggcatctgctctctagaggcaaggctgcccaagcagcctctgtacagagcggggcacagctcagacactcctggggacgtagagccagcattcttgctgctgagccacttccttgcaataggcagcagtggaggaaggggacggaggagagagaatcgggaggcagaagggctgggtgtgggcctgggtccccaggggacgtcttgacccccagctgctggcactcctccatcctcctgccatcactggagcagacatcagggacaagacaagatgccacctcctgccaccacagggcctgctcgcgcccccctccccccagaatacttgtccccctgcttggcaattgccctgggctctctgagtccaagaggtgggacctgctctgcaggggggcagttcctcaggtcaccacttgctggatccagccgatcacacctgtgatgcgggtgtagacgccgaagtagttaggtcggccacagcccaggccccagctgaccagccctgccaggaaccagcggccactgagtgccttgcataccagcggaccacccgagtcaccctggcaggcatccttcttgcccttgcggtagccggcacacagcatgcgtggcgtcacctggtagcgataggcctcgctgcacaggtcctgtgggatcaactgcacgtccactttctgcagagcattgctggtggggccgccttcgcgcagggcgccccagccagtgatccagcagtgcaggccgggttcgaagaagtgggagcgcgcgggcaggcagactggacgcacggcggccgagcgcaccaccgggtggtcgagctgcaacagcgccacgtcgtagtcgtggctgtcctcttcgtgatacggatgcaggagtaggcggctcaccttgaaggacacctctccaggccagcgcgagttctgccacaccttgcccaggaacaccgtccacagcgccggggaggccatgctgtcctcctggaagcaatgggcagctgttatcacccagcggtcagcgatgagggcgcccccacagatgtgtcgaccccgaacctggaggctggcctgccatggccactcaccctcggaggacacggccccaccaacaatgcgactggaggggccctggaggccacagtcacagtgctgctcgtctgagccgtccctgcagtcgggccgcccatcacactgtgggttgggcttcttcacgcagctctggtcctcacactggaaggtgaatgtcccgcagggcaccccttcctggcaccgctcttcatcgctgccgttgagacagtcaggctgcccgtcacagaccttaagcagtgagatgcacgtgctgtcctcttggcactggaatgtggctctgcaaacgcagtttctctcatccaggccgttggggcagtccttgaccccatcacaggcagggacgcagagtccgttcacagagcagaggaactctccagggcaggggtccgactggttgtacaagccatagtgcacccgcacaccaggccctgtgagggagatctgggaggtgaaattgatggtgatgccggccgtggccaccacggggatcctctcagcgtaaggctgcaggatgcgcaggccacacagcctcctgttctggatcgtccactggccctgggtgcacggcaaatcatacttctgcctccgcagtgcgtaggcgtcaaaccagagggccaagccgtagtccagagaaggcaccgtgaggtgccaggagcagtgggttcggggcgagtagtagctggggaagtacggggtgctgaggacgccctgggagtccagcctgtcatccagcgtcaggtttacctcgcaggcctggaagaccaccgactgcacggagagcataaaggggtcgtagtagctgtgcaggcccttcttccagaccaccgccatgatggcccccgatgccaggacttccaccacaggctcctggcggctgcagccatacaccgaggtgatgagcctcttctccaggggcccagccacgtcatacatggccagtcggtcccggcactcggccagcgtccactccagccggagtttcagcatgaggtcttcggggccctgcaggtgccacaggcagctggaggccaggtggtcgggtcccttcagccggaggacctgaccctggcccacgtagctgtagcggtaacaacccagcgtggaattcagtgcagctatgtctttcacactggcttctaggatcactaggccctcggggtccacttcgtactcggccctgtaggggacggccgccgagctgttgactgtggacagcagctcctccaccagcagtgcctgcaccacctcggggctcagcatcagccggcggtgctcggggatttggagaatgaaccagaagaagcaggtgagcggtccctccccaaaggaatagacggagctggagttgtaataagttcccaggcgggtgctggcgatgagctccttgagcatcttctgggctttggcggtttcactgcggaaggcactggattcccggcgggtaagatcctgggagaagtggcgattgagcacgcgaaggctgcctgagtacacctggctgaccgtcacctccgccttgtaccctaggaaataccagagtagcacccccactgaagtcagcacaaccagggtcagccacaggggcgccaggcggaggtagccccgggcttttctcttggagtcctcacaggcctcgaacatcccctctggctccgcttcctcgccatcacctccgtccccctgcccaccagccacctggggggccttggccacaggcatcctttgggagtggcggataggtgctgggcctgcacgcaggcctcagaagcctttgtttgtccaggccaaggcctccctacccccaccgtgccagcccggcctggatcaatggcctagagccatggccagggtgtctggcccttgtcccctgtggcctgtggccccaggctccatggggctcctcctgctgggcccaggacggcactgtgactgag

SEQ ID NO: 9 - DNA, 3252 bp, Macaca mulatta
  source 1..3252: mol_type = unassigned DNA
tgccgtcctgggcccagcaggaggagccccatggagcctggggccacaggccacaggggacaagggccagacaccctggccatggctctaggccattgatccaggccgggctggcacggtgggggtagggaggccttggcctggacaaacaaaggcttctgaggcctgcgtgcaggcccagcacctatccgccactcccaaaggatgcctgtggccaaggccccccaggtggctggcgggcagggggacggaggtgatggcgaggaagcggagccagaggggatgttcgaggcccgtgaggactccaagagaaaagcccggggctacctccgcctggcgcccctgtggctgaccctggttgtgctgacttcagtgggggtgctactctggtatttcctagggtacaaggcggaggtgacggtcagccaggtgtactcaggcagccttcgcgtgctcaatcgccacttctcccaggatcttacccgccgggaatccagtgccttccgcagtgaaaccgccaaagcccagaagatgctcaaggagctcatcgccagcacccgcctgggaacttattacaactccagctccgtctattcctttggggagggaccgctcacctgcttcttctggttcattctccaaatccccgagcaccgccggccgatgctgagccccgaggtggtgcaggcactgctggtggaggagctgctgtccacagtcaacagctcggcggccgtcccctacagggccgagtacgaagtggaccccgagggcctagtgatcctagaagccagtgtgaaagacatagctgcactgaattccacgctgggttgttaccgctacagctacgtgggccagggtcaggtcctccggctgaagggacccgaccacctggcctccagctgcctgtggcacctgcagggccccgaagacctcatgctgaaactccggctggagtggacgctggccgagtgccgggaccgactggccatgtatgacgtggctgggcccctggagaagaggctcatcacctcggtgtatggctgcagccgccaggagcctgtggtggaagtcctggcatcgggggccatcatggcggtggtctggaagaagggcctgcacagctactacgacccctttatgctctccgtgcagtcggtggtcttccaggcctgcgaggtaaacctgacgctggatgacaggctggactcccagggcgtcctcagcaccccgtacttccccagctactactcgccccgaacccactgctcctggcacctcacggtgccctctctggactacggcttggccctctggtttgacgcctacgcactgcggaggcagaagtatgatttgccgtgcacccagggccagtggacgatccagaacaggaggctgtgtggcctgcgcatcctgcagccttacgccgagaggatccccgtggtggccacggccggcatcaccatcaatttcacctcccagatctccctcacagggcctggtgtgcgggtgcactatggcttgtacaaccagtcggacccctgccctggagagttcctctgctctgtgaacggactctgcgtccctgcctgtgatggggtcaaggactgccccaacggcctggatgagagaaactgcgtttgcagagccacattccagtgccaagaggacagcacgtgcatctcactgcttaaggtctgtgacgggcagcctgactgtctcaatggcagcgatgaagagcggtgccaggaaggggtgccctgcgggacattcaccttccagtgtgaggaccagagctgcgtgaagaagcccaacccacagtgtgatgggcggcccgactgcagggacggctcagacgagcagcactgtgactgtggcctccagggcccctccagtcgcattgttggtggggccgtgtcctccgagggtgagtggccatggcaggccagcctccaggttcggggtcgacacatctgtgggggcgccctcatcgctgaccgctgggtgataacagctgcccattgcttccaggaggacagcatggcctccccggcgctgtggacggtgttcctgggcaaggtgtggcagaactcgcgctggcctggagaggtgtccttcaaggtgagccgcctactcctgcatccgtatcacgaagaggacagccacgactacgacgtggcgctgttgcagctcgaccacccggtggtgcgctcggccgccgtgcgtcccgtctgcctgcccgcgcgctcccacttcttcgaacccggcctgcactgctggatcactggctggggcgccctgcgcgaaggcggccccaccagcaatgctctgcagaaagtggacgtgcagttgatcccacaggacctgtgcagcgaggcctatcgctaccaggtgacgccacgcatgctgtgtgccggctaccgcaagggcaagaaggatgcctgccagggtgactcgggtggtccgctggtatgcaaggcactcagtggccgctggttcctggcagggctggtcagctggggcctgggctgtggccggcctaactacttcggcgtctacacccgcatcacaggtgtgatcggctggatccagcaagtggtgacctgaggaactgcccccctgcagagcaggtcccacctcttggactcaagagagcccagggcaattgccaagcagggggacaagtattctggggggaggggggcgcgagcaggccctgtggtggcaggaggtggcatcttgtcttgtccctgatgtctgctccagtgatggcaggaggatggaggagtgccagcagctgggggtcaagacgtcccctggggacccaggcccacacccagcccttctgcctcccgattctctctcctctgtccccttcctccactgctgcctattgcaaggaagtggctcagcagcaagaatgctggctctacgtccccaggagtgtctgagctgtgccccactctgtacagaggctgcttgggcagccttgcctctagagagcagatgccagcttcggaagcccctggtctaacttgggatctgggaatggaaggtgcccccataggaggggaccctcacagccccggggactgccaggtgggccggctgccaccgtaagccaaaaaaggtggggaagccctgactccaaggtccttgccccacccctgcctgccacctggcccctcacagcccagaccctcaccggcaggtgagctcagctgccctttggaataaagctgcctgatccaa

SEQ ID NO: 10 - DNA, 3252 bp, Macaca mulatta
  source 1..3252: mol_type = unassigned DNA
ttggatcaggcagctttattccaaagggcagctgagctcacctgccggtgagggtctgggctgtgaggggccaggtggcaggcaggggtggggcaaggaccttggagtcagggcttccccaccttttttggcttacggtggcagccggcccacctggcagtccccggggctgtgagggtcccctcctatgggggcaccttccattcccagatcccaagttagaccaggggcttccgaagctggcatctgctctctagaggcaaggctgcccaagcagcctctgtacagagtggggcacagctcagacactcctggggacgtagagccagcattcttgctgctgagccacttccttgcaataggcagcagtggaggaaggggacagaggagagagaatcgggaggcagaagggctgggtgtgggcctgggtccccaggggacgtcttgacccccagctgctggcactcctccatcctcctgccatcactggagcagacatcagggacaagacaagatgccacctcctgccaccacagggcctgctcgcgcccccctccccccagaatacttgtccccctgcttggcaattgccctgggctctcttgagtccaagaggtgggacctgctctgcaggggggcagttcctcaggtcaccacttgctggatccagccgatcacacctgtgatgcgggtgtagacgccgaagtagttaggccggccacagcccaggccccagctgaccagccctgccaggaaccagcggccactgagtgccttgcataccagcggaccacccgagtcaccctggcaggcatccttcttgcccttgcggtagccggcacacagcatgcgtggcgtcacctggtagcgataggcctcgctgcacaggtcctgtgggatcaactgcacgtccactttctgcagagcattgctggtggggccgccttcgcgcagggcgccccagccagtgatccagcagtgcaggccgggttcgaagaagtgggagcgcgcgggcaggcagacgggacgcacggcggccgagcgcaccaccgggtggtcgagctgcaacagcgccacgtcgtagtcgtggctgtcctcttcgtgatacggatgcaggagtaggcggctcaccttgaaggacacctctccaggccagcgcgagttctgccacaccttgcccaggaacaccgtccacagcgccggggaggccatgctgtcctcctggaagcaatgggcagctgttatcacccagcggtcagcgatgagggcgcccccacagatgtgtcgaccccgaacctggaggctggcctgccatggccactcaccctcggaggacacggccccaccaacaatgcgactggaggggccctggaggccacagtcacagtgctgctcgtctgagccgtccctgcagtcgggccgcccatcacactgtgggttgggcttcttcacgcagctctggtcctcacactggaaggtgaatgtcccgcagggcaccccttcctggcaccgctcttcatcgctgccattgagacagtcaggctgcccgtcacagaccttaagcagtgagatgcacgtgctgtcctcttggcactggaatgtggctctgcaaacgcagtttctctcatccaggccgttggggcagtccttgaccccatcacaggcagggacgcagagtccgttcacagagcagaggaactctccagggcaggggtccgactggttgtacaagccatagtgcacccgcacaccaggccctgtgagggagatctgggaggtgaaattgatggtgatgccggccgtggccaccacggggatcctctcggcgtaaggctgcaggatgcgcaggccacacagcctcctgttctggatcgtccactggccctgggtgcacggcaaatcatacttctgcctccgcagtgcgtaggcgtcaaaccagagggccaagccgtagtccagagagggcaccgtgaggtgccaggagcagtgggttcggggcgagtagtagctggggaagtacggggtgctgaggacgccctgggagtccagcctgtcatccagcgtcaggtttacctcgcaggcctggaagaccaccgactgcacggagagcataaaggggtcgtagtagctgtgcaggcccttcttccagaccaccgccatgatggcccccgatgccaggacttccaccacaggctcctggcggctgcagccatacaccgaggtgatgagcctcttctccaggggcccagccacgtcatacatggccagtcggtcccggcactcggccagcgtccactccagccggagtttcagcatgaggtcttcggggccctgcaggtgccacaggcagctggaggccaggtggtcgggtcccttcagccggaggacctgaccctggcccacgtagctgtagcggtaacaacccagcgtggaattcagtgcagctatgtctttcacactggcttctaggatcactaggccctcggggtccacttcgtactcggccctgtaggggacggccgccgagctgttgactgtggacagcagctcctccaccagcagtgcctgcaccacctcggggctcagcatcggccggcggtgctcggggatttggagaatgaaccagaagaagcaggtgagcggtccctccccaaaggaatagacggagctggagttgtaataagttcccaggcgggtgctggcgatgagctccttgagcatcttctgggctttggcggtttcactgcggaaggcactggattcccggcgggtaagatcctgggagaagtggcgattgagcacgcgaaggctgcctgagtacacctggctgaccgtcacctccgccttgtaccctaggaaataccagagtagcacccccactgaagtcagcacaaccagggtcagccacaggggcgccaggcggaggtagccccgggcttttctcttggagtcctcacgggcctcgaacatcccctctggctccgcttcctcgccatcacctccgtccccctgcccgccagccacctggggggccttggccacaggcatcctttgggagtggcggataggtgctgggcctgcacgcaggcctcagaagcctttgtttgtccaggccaaggcctccctacccccaccgtgccagcccggcctggatcaatggcctagagccatggccagggtgtctggcccttgtcccctgtggcctgtggccccaggctccatggggctcctcctgctgggcccaggacggca

SEQ ID NO: 11-13 - skipped (3 entries)

SEQ ID NO: 14 - protein, 16 aa, unidentified
  source 1..16: note = Description of Unknown: RFGF peptide sequence
AAVALLPAVLLALLAP

SEQ ID NO: 15 - protein, 11 aa, unidentified
  source 1..11: note = Description of Unknown: RFGF analogue sequence
AALLPVLLAAP

SEQ ID NO: 16 - protein, 13 aa, Human immunodeficiency virus 1
GRKKRRQRRRPPQ

SEQ ID NO: 17 - protein, 16 aa, Drosophila sp.
RQIKIWFQNRRMKWKK

SEQ ID NO: 18 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 5: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 12: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 20: mod_base = OTHER; note = 2'-deoxythimidine-3'-phosphorothioate
  misc_feature 1..19: note = RNA
  misc_feature 20..21: note = DNA
cttacgctgagtacttcgatt

SEQ ID NO: 19 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 7: mod_base = OTHER; note = 2'-O-methyluridine-3'-phosphate
  modified_base 11: mod_base = OTHER; note = 2'-O-methylcytidine-3'-phosphate
  modified_base 16: mod_base = OTHER; note = 2'-O-methyluridine-3'-phosphate
  modified_base 20: mod_base = OTHER; note = 2'-deoxythimidine-3'-phosphorothioate
  misc_feature 1..19: note = RNA
  misc_feature 20..21: note = DNA
tcgaagtactcagcgtaagtt

SEQ ID NO: 20 - RNA, 21 nt, synthetic construct
  source 1..21: mol_type = other RNA; note = Description of Artificial Sequence: Synthetic oligonucleotide
gcctgtgaggactccaagagt

SEQ ID NO: 21 - RNA, 21 nt, synthetic construct
  source 1..21: mol_type = other RNA; note = Description of Artificial Sequence: Synthetic oligonucleotide
ggtgctactctggtatttcct

SEQ ID NO: 22 - RNA, 21 nt, synthetic construct
  source 1..21: mol_type = other RNA; note = Description of Artificial Sequence: Synthetic oligonucleotide
gtgctactctggtatttcctt

SEQ ID NO: 23 - RNA, 21 nt, synthetic construct
  source 1..21: mol_type = other RNA; note = Description of Artificial Sequence: Synthetic oligonucleotide
tgctactctggtatttcctat

SEQ ID NO: 24 - RNA, 21 nt, synthetic construct
  source 1..21: mol_type = other RNA; note = Description of Artificial Sequence: Synthetic oligonucleotide
gctactctggtatttcctagt

SEQ ID NO: 25 - RNA, 21 nt, synthetic construct
  source 1..21: mol_type = other RNA; note = Description of Artificial Sequence: Synthetic oligonucleotide
ctactctggtatttcctaggt

SEQ ID NO: 26 - RNA, 21 nt, synthetic construct
  source 1..21: mol_type = other RNA; note = Description of Artificial Sequence: Synthetic oligonucleotide
tactctggtatttcctagggt

SEQ ID NO: 27 - RNA, 21 nt, synthetic construct
  source 1..21: mol_type = other RNA; note = Description of Artificial Sequence: Synthetic oligonucleotide
actctggtatttcctagggtt

SEQ ID NO: 28 - RNA, 21 nt, synthetic construct
  source 1..21: mol_type = other RNA; note = Description of Artificial Sequence: Synthetic oligonucleotide
ctctggtatttcctagggtat

SEQ ID NO: 29 - RNA, 21 nt, synthetic construct
  source 1..21: mol_type = other RNA; note = Description of Artificial Sequence: Synthetic oligonucleotide
tctggtatttcctagggtact

SEQ ID NO: 30 - RNA, 21 nt, synthetic construct
  source 1..21: mol_type = other RNA; note = Description of Artificial Sequence: Synthetic oligonucleotide
atttcctagggtacaaggcgt

SEQ ID NO: 31 - RNA, 21 nt, synthetic construct
  source 1..21: mol_type = other RNA; note = Description of Artificial Sequence: Synthetic oligonucleotide
ggtcagccaggtgtactcagt

SEQ ID NO: 32 - RNA, 21 nt, synthetic construct
  source 1..21: mol_type = other RNA; note = Description of Artificial Sequence: Synthetic oligonucleotide
agccaggtgtactcaggcagt

SEQ ID NO: 33 - RNA, 21 nt, synthetic construct
  source 1..21: mol_type = other RNA; note = Description of Artificial Sequence: Synthetic oligonucleotide
gccacttctcccaggatcttt

SEQ ID NO: 34 - RNA, 21 nt, synthetic construct
  source 1..21: mol_type = other RNA; note = Description of Artificial Sequence: Synthetic oligonucleotide
ttctcccaggatcttacccgt

SEQ ID NO: 35 - RNA, 21 nt, synthetic construct
  source 1..21: mol_type = other RNA; note = Description of Artificial Sequence: Synthetic oligonucleotide
tcccaggatcttacccgccgt

SEQ ID NO: 36 - RNA, 21 nt, synthetic construct
  source 1..21: mol_type = other RNA; note = Description of Artificial Sequence: Synthetic oligonucleotide
gccttccgcagtgaaaccgct

SEQ ID NO: 37 - RNA, 21 nt, synthetic construct
  source 1..21: mol_type = other RNA; note = Description of Artificial Sequence: Synthetic oligonucleotide
caactccagctccgtctattt

SEQ ID NO: 38 - RNA, 21 nt, synthetic construct
  source 1..21: mol_type = other RNA; note = Description of Artificial Sequence: Synthetic oligonucleotide
cagctccgtctattcctttgt

SEQ ID NO: 39 - RNA, 21 nt, synthetic construct
  source 1..21: mol_type = other RNA; note = Description of Artificial Sequence: Synthetic oligonucleotide
ctcacctgcttcttctggttt

SEQ ID NO: 40 - RNA, 21 nt, synthetic construct
  source 1..21: mol_type = other RNA; note = Description of Artificial Sequence: Synthetic oligonucleotide
tcacctgcttcttctggttct

SEQ ID NO: 41 - RNA, 21 nt, synthetic construct
  source 1..21: mol_type = other RNA; note = Description of Artificial Sequence: Synthetic oligonucleotide
acctgcttcttctggttcatt

SEQ ID NO: 42 - RNA, 21 nt, synthetic construct
  source 1..21: mol_type = other RNA; note = Description of Artificial Sequence: Synthetic oligonucleotide
cctgcttcttctggttcattt

SEQ ID NO: 43 - RNA, 21 nt, synthetic construct
  source 1..21: mol_type = other RNA; note = Description of Artificial Sequence: Synthetic oligonucleotide
tgcttcttctggttcattctt

SEQ ID NO: 44 - RNA, 21 nt, synthetic construct
  source 1..21: mol_type = other RNA; note = Description of Artificial Sequence: Synthetic oligonucleotide
gcttcttctggttcattctct

SEQ ID NO: 45 - RNA, 21 nt, synthetic construct
  source 1..21: mol_type = other RNA; note = Description of Artificial Sequence: Synthetic oligonucleotide
cttcttctggttcattctcct

SEQ ID NO: 46 - RNA, 21 nt, synthetic construct
  source 1..21: mol_type = other RNA; note = Description of Artificial Sequence: Synthetic oligonucleotide
ttcttctggttcattctccat

SEQ ID NO: 47 - RNA, 21 nt, synthetic construct
  source 1..21: mol_type = other RNA; note = Description of Artificial Sequence: Synthetic oligonucleotide
ctggttcattctccaaatcct

SEQ ID NO: 48 - RNA, 21 nt, synthetic construct
  source 1..21: mol_type = other RNA; note = Description of Artificial Sequence: Synthetic oligonucleotide
acagggccgagtacgaagtgt

SEQ ID NO: 49 - RNA, 21 nt, synthetic construct
  source 1..21: mol_type = other RNA; note = Description of Artificial Sequence: Synthetic oligonucleotide
cagggccgagtacgaagtggt

SEQ ID NO: 50 - RNA, 21 nt, synthetic construct
  source 1..21: mol_type = other RNA; note = Description of Artificial Sequence: Synthetic oligonucleotide
ccagtgtgaaagacatagctt

SEQ ID NO: 51 - RNA, 21 nt, synthetic construct
  source 1..21: mol_type = other RNA; note = Description of Artificial Sequence: Synthetic oligonucleotide
cagtgtgaaagacatagctgt

SEQ ID NO: 52 - RNA, 21 nt, synthetic construct
  source 1..21: mol_type = other RNA; note = Description of Artificial Sequence: Synthetic oligonucleotide
attgaattccacgctgggttt

SEQ ID NO: 53 - RNA, 21 nt, synthetic construct
  source 1..21: mol_type = other RNA; note = Description of Artificial Sequence: Synthetic oligonucleotide
ttgaattccacgctgggttgt

SEQ ID NO: 54 - RNA, 21 nt, synthetic construct
  source 1..21: mol_type = other RNA; note = Description of Artificial Sequence: Synthetic oligonucleotide
tgaattccacgctgggttgtt

SEQ ID NO: 55 - RNA, 21 nt, synthetic construct
  source 1..21: mol_type = other RNA; note = Description of Artificial Sequence: Synthetic oligonucleotide
aattccacgctgggttgttat

SEQ ID NO: 56 - RNA, 21 nt, synthetic construct
  source 1..21: mol_type = other RNA; note = Description of Artificial Sequence: Synthetic oligonucleotide
tccacgctgggttgttaccgt

SEQ ID NO: 57 - RNA, 21 nt, synthetic construct
  source 1..21: mol_type = other RNA; note = Description of Artificial Sequence: Synthetic oligonucleotide
ccacgctgggttgttaccgct

SEQ ID NO: 58 - RNA, 21 nt, synthetic construct
  source 1..21: mol_type = other RNA; note = Description of Artificial Sequence: Synthetic oligonucleotide
cacgctgggttgttaccgctt

SEQ ID NO: 59 - RNA, 21 nt, synthetic construct
  source 1..21: mol_type = other RNA; note = Description of Artificial Sequence: Synthetic oligonucleotide
ctgggttgttaccgctacagt

SEQ ID NO: 60 - RNA, 21 nt, synthetic construct
  source 1..21: mol_type = other RNA; note = Description of Artificial Sequence: Synthetic oligonucleotide
gggaccgactggccatgtatt

SEQ ID NO: 61 - RNA, 21 nt, synthetic construct
  source 1..21: mol_type = other RNA; note = Description of Artificial Sequence: Synthetic oligonucleotide
ggaccgactggccatgtatgt

SEQ ID NO: 62 - RNA, 21 nt, synthetic construct
  source 1..21: mol_type = other RNA; note = Description of Artificial Sequence: Synthetic oligonucleotide
accgactggccatgtatgact

SEQ ID NO: 63 - RNA, 21 nt, synthetic construct
  source 1..21: mol_type = other RNA; note = Description of Artificial Sequence: Synthetic oligonucleotide
ccgactggccatgtatgacgt

SEQ ID NO: 64 - RNA, 21 nt, synthetic construct
  source 1..21: mol_type = other RNA; note = Description of Artificial Sequence: Synthetic oligonucleotide
gactggccatgtatgacgtgt

SEQ ID NO: 65 - RNA, 21 nt, synthetic construct
  source 1..21: mol_type = other RNA; note = Description of Artificial Sequence: Synthetic oligonucleotide
actggccatgtatgacgtggt

SEQ ID NO: 66 - RNA, 21 nt, synthetic construct
  source 1..21: mol_type = other RNA; note = Description of Artificial Sequence: Synthetic oligonucleotide
ctggccatgtatgacgtggct

SEQ ID NO: 67 - RNA, 21 nt, synthetic construct
  source 1..21: mol_type = other RNA; note = Description of Artificial Sequence: Synthetic oligonucleotide
aggctcatcacctcggtgtat

SEQ ID NO: 68 - RNA, 21 nt, synthetic construct
  source 1..21: mol_type = other RNA; note = Description of Artificial Sequence: Synthetic oligonucleotide
gcctgcacagctactacgact

SEQ ID NO: 69 - RNA, 21 nt, synthetic construct
  source 1..21: mol_type = other RNA; note = Description of Artificial Sequence: Synthetic oligonucleotide
cctgcacagctactacgacct

SEQ ID NO: 70 - RNA, 21 nt, synthetic construct
  source 1..21: mol_type = other RNA; note = Description of Artificial Sequence: Synthetic oligonucleotide
cctctctggactacggcttgt

SEQ ID NO: 71 - RNA, 21 nt, synthetic construct
  source 1..21: mol_type = other RNA; note = Description of Artificial Sequence: Synthetic oligonucleotide
tctctggactacggcttggct

SEQ ID NO: 72 - RNA, 21 nt, synthetic construct
  source 1..21: mol_type = other RNA; note = Description of Artificial Sequence: Synthetic oligonucleotide
tacggcttggccctctggttt

SEQ ID NO: 73 - RNA, 21 nt, synthetic construct
  source 1..21: mol_type = other RNA; note = Description of Artificial Sequence: Synthetic oligonucleotide
acggcttggccctctggtttt

SEQ ID NO: 74 - RNA, 21 nt, synthetic construct
  source 1..21: mol_type = other RNA; note = Description of Artificial Sequence: Synthetic oligonucleotide
cggcttggccctctggtttgt

SEQ ID NO: 75 - RNA, 21 nt, synthetic construct
  source 1..21: mol_type = other RNA; note = Description of Artificial Sequence: Synthetic oligonucleotide
ggcttggccctctggtttgat

SEQ ID NO: 76 - RNA, 21 nt, synthetic construct
  source 1..21: mol_type = other RNA; note = Description of Artificial Sequence: Synthetic oligonucleotide
gaggaggcagaagtatgattt

SEQ ID NO: 77 - RNA, 21 nt, synthetic construct
  source 1..21: mol_type = other RNA; note = Description of Artificial Sequence: Synthetic oligonucleotide
ggaggcagaagtatgatttgt

SEQ ID NO: 78 - RNA, 21 nt, synthetic construct
  source 1..21: mol_type = other RNA; note = Description of Artificial Sequence: Synthetic oligonucleotide
gaggcagaagtatgatttgct

SEQ ID NO: 79 - RNA, 21 nt, synthetic construct
  source 1..21: mol_type = other RNA; note = Description of Artificial Sequence: Synthetic oligonucleotide
aggcagaagtatgatttgcct

SEQ ID NO: 80 - RNA, 21 nt, synthetic construct
  source 1..21: mol_type = other RNA; note = Description of Artificial Sequence: Synthetic oligonucleotide
ggcagaagtatgatttgccgt

SEQ ID NO: 81 - RNA, 21 nt, synthetic construct
  source 1..21: mol_type = other RNA; note = Description of Artificial Sequence: Synthetic oligonucleotide
gcagaagtatgatttgccgtt

SEQ ID NO: 82 - RNA, 21 nt, synthetic construct
  source 1..21: mol_type = other RNA; note = Description of Artificial Sequence: Synthetic oligonucleotide
cagaagtatgatttgccgtgt

SEQ ID NO: 83 - RNA, 21 nt, synthetic construct
  source 1..21: mol_type = other RNA; note = Description of Artificial Sequence: Synthetic oligonucleotide
agaagtatgatttgccgtgct

SEQ ID NO: 84 - RNA, 21 nt, synthetic construct
  source 1..21: mol_type = other RNA; note = Description of Artificial Sequence: Synthetic oligonucleotide
gaagtatgatttgccgtgcat

SEQ ID NO: 85 - RNA, 21 nt, synthetic construct
  source 1..21: mol_type = other RNA; note = Description of Artificial Sequence: Synthetic oligonucleotide
cagtggacgatccagaacagt

SEQ ID NO: 86 - RNA, 21 nt, synthetic construct
  source 1..21: mol_type = other RNA; note = Description of Artificial Sequence: Synthetic oligonucleotide
agtggacgatccagaacaggt

SEQ ID NO: 87 - RNA, 21 nt, synthetic construct
  source 1..21: mol_type = other RNA; note = Description of Artificial Sequence: Synthetic oligonucleotide
ccagaacaggaggctgtgtgt

SEQ ID NO: 88 - RNA, 21 nt, synthetic construct
  source 1..21: mol_type = other RNA; note = Description of Artificial Sequence: Synthetic oligonucleotide
agaacaggaggctgtgtggct

SEQ ID NO: 89 - RNA, 21 nt, synthetic construct
  source 1..21: mol_type = other RNA; note = Description of Artificial Sequence: Synthetic oligonucleotide
tgtgcgggtgcactatggctt

SEQ ID NO: 90 - RNA, 21 nt, synthetic construct
  source 1..21: mol_type = other RNA; note = Description of Artificial Sequence: Synthetic oligonucleotide
gtgcgggtgcactatggcttt

SEQ ID NO: 91 - RNA, 21 nt, synthetic construct
  source 1..21: mol_type = other RNA; note = Description of Artificial Sequence: Synthetic oligonucleotide
gcgggtgcactatggcttgtt

SEQ ID NO: 92 - RNA, 21 nt, synthetic construct
  source 1..21: mol_type = other RNA; note = Description of Artificial Sequence: Synthetic oligonucleotide
gggtgcactatggcttgtact

SEQ ID NO: 93 - RNA, 21 nt, synthetic construct
  source 1..21: mol_type = other RNA; note = Description of Artificial Sequence: Synthetic oligonucleotide
actatggcttgtacaaccagt

SEQ ID NO: 94 - RNA, 21 nt, synthetic construct
  source 1..21: mol_type = other RNA; note = Description of Artificial Sequence: Synthetic oligonucleotide
gcttgtacaaccagtcggact

SEQ ID NO: 95 - RNA, 21 nt, synthetic construct
  source 1..21: mol_type = other RNA; note = Description of Artificial Sequence: Synthetic oligonucleotide
ctgccctggagagttcctctt

SEQ ID NO: 96 - RNA, 21 nt, synthetic construct
  source 1..21: mol_type = other RNA; note = Description of Artificial Sequence: Synthetic oligonucleotide
gcctggatgagagaaactgct

SEQ ID NO: 97 - RNA, 21 nt, synthetic construct
  source 1..21: mol_type = other RNA; note = Description of Artificial Sequence: Synthetic oligonucleotide
tggatgagagaaactgcgttt

SEQ ID NO: 98 - RNA, 21 nt, synthetic construct
  source 1..21: mol_type = other RNA; note = Description of Artificial Sequence: Synthetic oligonucleotide
ggatgagagaaactgcgtttt

SEQ ID NO: 99 - RNA, 21 nt, synthetic construct
  source 1..21: mol_type = other RNA; note = Description of Artificial Sequence: Synthetic oligonucleotide
gagagaaactgcgtttgcagt

SEQ ID NO: 100 - RNA, 21 nt, synthetic construct
  source 1..21: mol_type = other RNA; note = Description of Artificial Sequence: Synthetic oligonucleotide
tttgcagagccacattccagt

SEQ ID NO: 101 - RNA, 21 nt, synthetic construct
  source 1..21: mol_type = other RNA; note = Description of Artificial Sequence: Synthetic oligonucleotide
gtgggacattcaccttccagt

SEQ ID NO: 102 - RNA, 21 nt, synthetic construct
  source 1..21: mol_type = other RNA; note = Description of Artificial Sequence: Synthetic oligonucleotide
tgggacattcaccttccagtt

SEQ ID NO: 103 - RNA, 21 nt, synthetic construct
  source 1..21: mol_type = other RNA; note = Description of Artificial Sequence: Synthetic oligonucleotide
ggacattcaccttccagtgtt

SEQ ID NO: 104 - RNA, 21 nt, synthetic construct
  source 1..21: mol_type = other RNA; note = Description of Artificial Sequence: Synthetic oligonucleotide
gacattcaccttccagtgtgt

SEQ ID NO: 105 - RNA, 21 nt, synthetic construct
  source 1..21: mol_type = other RNA; note = Description of Artificial Sequence: Synthetic oligonucleotide
acattcaccttccagtgtgat

SEQ ID NO: 106 - RNA, 21 nt, synthetic construct
  source 1..21: mol_type = other RNA; note = Description of Artificial Sequence: Synthetic oligonucleotide
cattcaccttccagtgtgagt

SEQ ID NO: 107 - RNA, 21 nt, synthetic construct
  source 1..21: mol_type = other RNA; note = Description of Artificial Sequence: Synthetic oligonucleotide
atcgctgaccgctgggtgatt

SEQ ID NO: 108 - RNA, 21 nt, synthetic construct
  source 1..21: mol_type = other RNA; note = Description of Artificial Sequence: Synthetic oligonucleotide
tgaccgctgggtgataacagt

SEQ ID NO: 109 - RNA, 21 nt, synthetic construct
  source 1..21: mol_type = other RNA; note = Description of Artificial Sequence: Synthetic oligonucleotide
cgtgttcctgggcaaggtgtt

SEQ ID NO: 110 - RNA, 21 nt, synthetic construct
  source 1..21: mol_type = other RNA; note = Description of Artificial Sequence: Synthetic oligonucleotide
gtgttcctgggcaaggtgtgt

SEQ ID NO: 111 - RNA, 21 nt, synthetic construct
  source 1..21: mol_type = other RNA; note = Description of Artificial Sequence: Synthetic oligonucleotide
gcaaggtgtggcagaactcgt

SEQ ID NO: 112 - RNA, 21 nt, synthetic construct
  source 1..21: mol_type = other RNA; note = Description of Artificial Sequence: Synthetic oligonucleotide
aaggtgtggcagaactcgcgt

SEQ ID NO: 113 - RNA, 21 nt, synthetic construct
  source 1..21: mol_type = other RNA; note = Description of Artificial Sequence: Synthetic oligonucleotide
ctggagaggtgtccttcaagt

SEQ ID NO: 114 - RNA, 21 nt, synthetic construct
  source 1..21: mol_type = other RNA; note = Description of Artificial Sequence: Synthetic oligonucleotide
tggagaggtgtccttcaaggt

SEQ ID NO: 115 - RNA, 21 nt, synthetic construct
  source 1..21: mol_type = other RNA; note = Description of Artificial Sequence: Synthetic oligonucleotide
gagaggtgtccttcaaggtgt

SEQ ID NO: 116 - RNA, 21 nt, synthetic construct
  source 1..21: mol_type = other RNA; note = Description of Artificial Sequence: Synthetic oligonucleotide
agaggtgtccttcaaggtgat

SEQ ID NO: 117 - RNA, 21 nt, synthetic construct
  source 1..21: mol_type = other RNA; note = Description of Artificial Sequence: Synthetic oligonucleotide
atcccacaggacctgtgcagt

SEQ ID NO: 118 - RNA, 21 nt, synthetic construct
  source 1..21: mol_type = other RNA; note = Description of Artificial Sequence: Synthetic oligonucleotide
tgacgccacgcatgctgtgtt

SEQ ID NO: 119 - RNA, 21 nt, synthetic construct
  source 1..21: mol_type = other RNA; note = Description of Artificial Sequence: Synthetic oligonucleotide
gacgccacgcatgctgtgtgt

SEQ ID NO: 120 - RNA, 21 nt, synthetic construct
  source 1..21: mol_type = other RNA; note = Description of Artificial Sequence: Synthetic oligonucleotide
gctaccgcaagggcaagaagt

SEQ ID NO: 121 - RNA, 21 nt, synthetic construct
  source 1..21: mol_type = other RNA; note = Description of Artificial Sequence: Synthetic oligonucleotide
ctaccgcaagggcaagaaggt

SEQ ID NO: 122 - RNA, 21 nt, synthetic construct
  source 1..21: mol_type = other RNA; note = Description of Artificial Sequence: Synthetic oligonucleotide
ggcctaactacttcggcgtct

SEQ ID NO: 123 - RNA, 21 nt, synthetic construct
  source 1..21: mol_type = other RNA; note = Description of Artificial Sequence: Synthetic oligonucleotide
gcctaactacttcggcgtctt

SEQ ID NO: 124 - RNA, 21 nt, synthetic construct
  source 1..21: mol_type = other RNA; note = Description of Artificial Sequence: Synthetic oligonucleotide
ctacacccgcatcacaggtgt

SEQ ID NO: 125 - RNA, 21 nt, synthetic construct
  source 1..21: mol_type = other RNA; note = Description of Artificial Sequence: Synthetic oligonucleotide
gctggatccagcaagtggtgt

SEQ ID NO: 126 - RNA, 21 nt, synthetic construct
  source 1..21: mol_type = other RNA; note = Description of Artificial Sequence: Synthetic oligonucleotide
tggcaggaggtggcatcttgt

SEQ ID NO: 127 - RNA, 21 nt, synthetic construct
  source 1..21: mol_type = other RNA; note = Description of Artificial Sequence: Synthetic oligonucleotide
ggcaggaggtggcatcttgtt

SEQ ID NO: 128 - RNA, 21 nt, synthetic construct
  source 1..21: mol_type = other RNA; note = Description of Artificial Sequence: Synthetic oligonucleotide
gcaggaggtggcatcttgtct

SEQ ID NO: 129 - RNA, 21 nt, synthetic construct
  source 1..21: mol_type = other RNA; note = Description of Artificial Sequence: Synthetic oligonucleotide
caggaggtggcatcttgtctt

SEQ ID NO: 130 - RNA, 21 nt, synthetic construct
  source 1..21: mol_type = other RNA; note = Description of Artificial Sequence: Synthetic oligonucleotide
tgatgtctgctccagtgatgt

SEQ ID NO: 131 - RNA, 21 nt, synthetic construct
  source 1..21: mol_type = other RNA; note = Description of Artificial Sequence: Synthetic oligonucleotide
caattctctctcctccgtcct

SEQ ID NO: 132 - RNA, 21 nt, synthetic construct
  source 1..21: mol_type = other RNA; note = Description of Artificial Sequence: Synthetic oligonucleotide
ggctcagcagcaagaatgctt

SEQ ID NO: 133 - RNA, 21 nt, synthetic construct
  source 1..21: mol_type = other RNA; note = Description of Artificial Sequence: Synthetic oligonucleotide
gctcagcagcaagaatgctgt

SEQ ID NO: 134 - RNA, 21 nt, synthetic construct
  source 1..21: mol_type = other RNA; note = Description of Artificial Sequence: Synthetic oligonucleotide
ctggtctaacttgggatctgt

SEQ ID NO: 135 - RNA, 21 nt, synthetic construct
  source 1..21: mol_type = other RNA; note = Description of Artificial Sequence: Synthetic oligonucleotide
tggtctaacttgggatctggt

SEQ ID NO: 136 - RNA, 21 nt, synthetic construct
  source 1..21: mol_type = other RNA; note = Description of Artificial Sequence: Synthetic oligonucleotide
ggtctaacttgggatctgggt

SEQ ID NO: 137 - RNA, 21 nt, synthetic construct
  source 1..21: mol_type = other RNA; note = Description of Artificial Sequence: Synthetic oligonucleotide
taacttgggatctgggaatgt

SEQ ID NO: 138 - RNA, 21 nt, synthetic construct
  source 1..21: mol_type = other RNA; note = Description of Artificial Sequence: Synthetic oligonucleotide
ttgggatctgggaatggaagt

SEQ ID NO: 139 - RNA, 21 nt, synthetic construct
  source 1..21: mol_type = other RNA; note = Description of Artificial Sequence: Synthetic oligonucleotide
ggatctgggaatggaaggtgt

SEQ ID NO: 140 - RNA, 21 nt, synthetic construct
  source 1..21: mol_type = other RNA; note = Description of Artificial Sequence: Synthetic oligonucleotide
tgagctcagctgccctttggt

SEQ ID NO: 141 - RNA, 21 nt, synthetic construct
  source 1..21: mol_type = other RNA; note = Description of Artificial Sequence: Synthetic oligonucleotide
gagctcagctgccctttggat

SEQ ID NO: 142 - RNA, 21 nt, synthetic construct
  source 1..21: mol_type = other RNA; note = Description of Artificial Sequence: Synthetic oligonucleotide
gctcagctgccctttggaatt

SEQ ID NO: 143 - RNA, 21 nt, synthetic construct
  source 1..21: mol_type = other RNA; note = Description of Artificial Sequence: Synthetic oligonucleotide
agctgccctttggaataaagt

SEQ ID NO: 144 - RNA, 21 nt, synthetic construct
  source 1..21: mol_type = other RNA; note = Description of Artificial Sequence: Synthetic oligonucleotide
ctgccctttggaataaagctt

SEQ ID NO: 145 - RNA, 21 nt, synthetic construct
  source 1..21: mol_type = other RNA; note = Description of Artificial Sequence: Synthetic oligonucleotide
tgccctttggaataaagctgt

SEQ ID NO: 146 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actcttggagtcctcacaggcct

SEQ ID NO: 147 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggaaataccagagtagcacccc

SEQ ID NO: 148 - RNA, 23 nt, synthetic construct
  source 1..23: mol_type = other RNA; note = Description of Artificial Sequence: Synthetic oligonucleotide
aaggaaataccagagtagcaccc

SEQ ID NO: 149 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataggaaataccagagtagcacc

SEQ ID NO: 150 - RNA, 23 nt, synthetic construct
  source 1..23: mol_type = other RNA; note = Description of Artificial Sequence: Synthetic oligonucleotide
actaggaaataccagagtagcac

SEQ ID NO: 151 - RNA, 23 nt, synthetic construct
  source 1..23: mol_type = other RNA; note = Description of Artificial Sequence: Synthetic oligonucleotide
acctaggaaataccagagtagca

SEQ ID NO: 152 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
accctaggaaataccagagtagc

SEQ ID NO: 153 - RNA, 23 nt, synthetic construct
  source 1..23: mol_type = other RNA; note = Description of Artificial Sequence: Synthetic oligonucleotide
aaccctaggaaataccagagtag

SEQ ID NO: 154 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
ataccctaggaaataccagagta

SEQ ID NO: 155 - RNA, 23 nt, synthetic construct
  source 1..23: mol_type = other RNA; note = Description of Artificial Sequence: Synthetic oligonucleotide
agtaccctaggaaataccagagt

SEQ ID NO: 156 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acgccttgtaccctaggaaatac

SEQ ID NO: 157 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
actgagtacacctggctgaccat

SEQ ID NO: 158 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
actgcctgagtacacctggctga

SEQ ID NO: 159 - RNA, 23 nt, synthetic construct
  source 1..23: mol_type = other RNA; note = Description of Artificial Sequence: Synthetic oligonucleotide
aaagatcctgggagaagtggcga

SEQ ID NO: 160 - RNA, 23 nt, synthetic construct
  source 1..23: mol_type = other RNA; note = Description of Artificial Sequence: Synthetic oligonucleotide
acgggtaagatcctgggagaagt

SEQ ID NO: 161 - RNA, 23 nt, synthetic construct
  source 1..23: mol_type = other RNA; note = Description of Artificial Sequence: Synthetic oligonucleotide
acggcgggtaagatcctgggaga

SEQ ID NO: 162 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
agcggtttcactgcggaaggcac

SEQ ID NO: 163 - RNA, 23 nt, synthetic construct
  source 1..23: mol_type = other RNA; note = Description of Artificial Sequence: Synthetic oligonucleotide
aaatagacggagctggagttgta

SEQ ID NO: 164 - RNA, 23 nt, synthetic construct
  source 1..23: mol_type = other RNA; note = Description of Artificial Sequence: Synthetic oligonucleotide
acaaaggaatagacggagctgga

SEQ ID NO: 165 - RNA, 23 nt, synthetic construct
  source 1..23: mol_type = other RNA; note = Description of Artificial Sequence: Synthetic oligonucleotide
aaaccagaagaagcaggtgaggg

SEQ ID NO: 166 - RNA, 23 nt, synthetic construct
  source 1..23: mol_type = other RNA; note = Description of Artificial Sequence: Synthetic oligonucleotide
agaaccagaagaagcaggtgagg

SEQ ID NO: 167 - RNA, 23 nt, synthetic construct
  source 1..23: mol_type = other RNA; note = Description of Artificial Sequence: Synthetic oligonucleotide
aatgaaccagaagaagcaggtga

SEQ ID NO: 168 - RNA, 23 nt, synthetic construct
  source 1..23: mol_type = other RNA; note = Description of Artificial Sequence: Synthetic oligonucleotide
aaatgaaccagaagaagcaggtg

SEQ ID NO: 169 - RNA, 23 nt, synthetic construct
  source 1..23: mol_type = other RNA; note = Description of Artificial Sequence: Synthetic oligonucleotide
aagaatgaaccagaagaagcagg

SEQ ID NO: 170 - RNA, 23 nt, synthetic construct
  source 1..23: mol_type = other RNA; note = Description of Artificial Sequence: Synthetic oligonucleotide
  modified_base 7: mod_base = OTHER; note = Thymine
agagaatgaaccagaagaagcag

SEQ ID NO: 171 - RNA, 23 nt, synthetic construct
  source 1..23: mol_type = other RNA; note = Description of Artificial Sequence: Synthetic oligonucleotide
aggagaatgaaccagaagaagca

SEQ ID NO: 172 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atggagaatgaaccagaagaagc

SEQ ID NO: 173 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aggatttggagaatgaaccagaa

SEQ ID NO: 174 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
acacttcgtactcggccctgtag

SEQ ID NO: 175 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
accacttcgtactcggccctgta

SEQ ID NO: 176 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 12: mod_base = OTHER; note = Thymine
aagctatgtctttcacactggct

SEQ ID NO: 177 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acagctatgtctttcacactggc

SEQ ID NO: 178 - RNA, 23 nt, synthetic construct
  source 1..23: mol_type = other RNA; note = Description of Artificial Sequence: Synthetic oligonucleotide
aaacccagcgtggaattcaatgc

SEQ ID NO: 179 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acaacccagcgtggaattcaatg

SEQ ID NO: 180 - RNA, 23 nt, synthetic construct
  source 1..23: mol_type = other RNA; note = Description of Artificial Sequence: Synthetic oligonucleotide
aacaacccagcgtggaattcaat

SEQ ID NO: 181 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataacaacccagcgtggaattca

SEQ ID NO: 182 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
acggtaacaacccagcgtggaat

SEQ ID NO: 183 - RNA, 23 nt, synthetic construct
  source 1..23: mol_type = other RNA; note = Description of Artificial Sequence: Synthetic oligonucleotide
agcggtaacaacccagcgtggaa

SEQ ID NO: 184 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagcggtaacaacccagcgtgga

SEQ ID NO: 185 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actgtagcggtaacaacccagcg

SEQ ID NO: 186 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aatacatggccagtcggtcccgg

SEQ ID NO: 187 - RNA, 23 nt, synthetic construct
  source 1..23: mol_type = other RNA; note = Description of Artificial Sequence: Synthetic oligonucleotide
acatacatggccagtcggtcccg

SEQ ID NO: 188 - RNA, 23 nt, synthetic construct
  source 1..23: mol_type = other RNA; note = Description of Artificial Sequence: Synthetic oligonucleotide
agtcatacatggccagtcggtcc

SEQ ID NO: 189 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acgtcatacatggccagtcggtc

SEQ ID NO: 190 - RNA, 23 nt, synthetic construct
  source 1..23: mol_type = other RNA; note = Description of Artificial Sequence: Synthetic oligonucleotide
acacgtcatacatggccagtcgg

SEQ ID NO: 191 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
accacgtcatacatggccagtcg

SEQ ID NO: 192 - RNA, 23 nt, synthetic construct
  source 1..23: mol_type = other RNA; note = Description of Artificial Sequence: Synthetic oligonucleotide
agccacgtcatacatggccagtc

SEQ ID NO: 193 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
atacaccgaggtgatgagcctct

SEQ ID NO: 194 - RNA, 23 nt, synthetic construct
  source 1..23: mol_type = other RNA; note = Description of Artificial Sequence: Synthetic oligonucleotide
agtcgtagtagctgtgcaggccc

SEQ ID NO: 195 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggtcgtagtagctgtgcaggcc

SEQ ID NO: 196 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acaagccgtagtccagagagggc

SEQ ID NO: 197 - RNA, 23 nt, synthetic construct
  source 1..23: mol_type = other RNA; note = Description of Artificial Sequence: Synthetic oligonucleotide
agccaagccgtagtccagagagg

SEQ ID NO: 198 - RNA, 23 nt, synthetic construct
  source 1..23: mol_type = other RNA; note = Description of Artificial Sequence: Synthetic oligonucleotide
aaaccagagggccaagccgtagt

SEQ ID NO: 199 - RNA, 23 nt, synthetic construct
  source 1..23: mol_type = other RNA; note = Description of Artificial Sequence: Synthetic oligonucleotide
aaaaccagagggccaagccgtag

SEQ ID NO: 200 - RNA, 23 nt, synthetic construct
  source 1..23: mol_type = other RNA; note = Description of Artificial Sequence: Synthetic oligonucleotide
acaaaccagagggccaagccgta

SEQ ID NO: 201 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atcaaaccagagggccaagccgt

SEQ ID NO: 202 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaatcatacttctgcctcctcag

SEQ ID NO: 203 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acaaatcatacttctgcctcctc

SEQ ID NO: 204 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcaaatcatacttctgcctcct

SEQ ID NO: 205 - RNA, 23 nt, synthetic construct
  source 1..23: mol_type = other RNA; note = Description of Artificial Sequence: Synthetic oligonucleotide
aggcaaatcatacttctgcctcc

SEQ ID NO: 206 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acggcaaatcatacttctgcctc

SEQ ID NO: 207 - RNA, 23 nt, synthetic construct
  source 1..23: mol_type = other RNA; note = Description of Artificial Sequence: Synthetic oligonucleotide
aacggcaaatcatacttctgcct

SEQ ID NO: 208 - RNA, 23 nt, synthetic construct
  source 1..23: mol_type = other RNA; note = Description of Artificial Sequence: Synthetic oligonucleotide
acacggcaaatcatacttctgcc

SEQ ID NO: 209 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agcacggcaaatcatacttctgc

SEQ ID NO: 210 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgcacggcaaatcatacttctg

SEQ ID NO: 211 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
actgttctggatcgtccactggc

SEQ ID NO: 212 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acctgttctggatcgtccactgg

SEQ ID NO: 213 - RNA, 23 nt, synthetic construct
  source 1..23: mol_type = other RNA; note = Description of Artificial Sequence: Synthetic oligonucleotide
acacacagcctcctgttctggat

SEQ ID NO: 214 - RNA, 23 nt, synthetic construct
  source 1..23: mol_type = other RNA; note = Description of Artificial Sequence: Synthetic oligonucleotide
agccacacagcctcctgttctgg

SEQ ID NO: 215 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagccatagtgcacccgcacacc

SEQ ID NO: 216 - RNA, 23 nt, synthetic construct
  source 1..23: mol_type = other RNA; note = Description of Artificial Sequence: Synthetic oligonucleotide
aaagccatagtgcacccgcacac

SEQ ID NO: 217 - RNA, 23 nt, synthetic construct
  source 1..23: mol_type = other RNA; note = Description of Artificial Sequence: Synthetic oligonucleotide
aacaagccatagtgcacccgcac

SEQ ID NO: 218 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agtacaagccatagtgcacccgc

SEQ ID NO: 219 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
actggttgtacaagccatagtgc

SEQ ID NO: 220 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agtccgactggttgtacaagcca

SEQ ID NO: 221 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aagaggaactctccagggcaggg

SEQ ID NO: 222 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
agcagtttctctcatccaggccg

SEQ ID NO: 223 - RNA, 23 nt, synthetic construct
  source 1..23: mol_type = other RNA; note = Description of Artificial Sequence: Synthetic oligonucleotide
aaacgcagtttctctcatccagg

SEQ ID NO: 224 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aaaacgcagtttctctcatccag

SEQ ID NO: 225 - RNA, 23 nt, synthetic construct
  source 1..23: mol_type = other RNA; note = Description of Artificial Sequence: Synthetic oligonucleotide
actgcaaacgcagtttctctcat

SEQ ID NO: 226 - RNA, 23 nt, synthetic construct
  source 1..23: mol_type = other RNA; note = Description of Artificial Sequence: Synthetic oligonucleotide
actggaatgtggctctgcaaacg

SEQ ID NO: 227 - RNA, 23 nt, synthetic construct
  source 1..23: mol_type = other RNA; note = Description of Artificial Sequence: Synthetic oligonucleotide
actggaaggtgaatgtcccacat

SEQ ID NO: 228 - RNA, 23 nt, synthetic construct
  source 1..23: mol_type = other RNA; note = Description of Artificial Sequence: Synthetic oligonucleotide
aactggaaggtgaatgtcccaca

SEQ ID NO: 229 - RNA, 23 nt, synthetic construct
  source 1..23: mol_type = other RNA; note = Description of Artificial Sequence: Synthetic oligonucleotide
aacactggaaggtgaatgtccca

SEQ ID NO: 230 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acacactggaaggtgaatgtccc

SEQ ID NO: 231 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atcacactggaaggtgaatgtcc

SEQ ID NO: 232 - RNA, 23 nt, synthetic construct
  source 1..23: mol_type = other RNA; note = Description of Artificial Sequence: Synthetic oligonucleotide
actcacactggaaggtgaatgtc

SEQ ID NO: 233 - RNA, 23 nt, synthetic construct
  source 1..23: mol_type = other RNA; note = Description of Artificial Sequence: Synthetic oligonucleotide
aatcacccagcggtcagcgatga

SEQ ID NO: 234 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actgttatcacccagcggtcagc

SEQ ID NO: 235 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aacaccttgcccaggaacacggt

SEQ ID NO: 236 - RNA, 23 nt, synthetic construct
  source 1..23: mol_type = other RNA; note = Description of Artificial Sequence: Synthetic oligonucleotide
acacaccttgcccaggaacacgg

SEQ ID NO: 237 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acgagttctgccacaccttgccc

SEQ ID NO: 238 - RNA, 23 nt, synthetic construct
  source 1..23: mol_type = other RNA; note = Description of Artificial Sequence: Synthetic oligonucleotide
acgcgagttctgccacaccttgc

SEQ ID NO: 239 - RNA, 23 nt, synthetic construct
  source 1..23: mol_type = other RNA; note = Description of Artificial Sequence: Synthetic oligonucleotide
acttgaaggacacctctccaggc

SEQ ID NO: 240 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
accttgaaggacacctctccagg

SEQ ID NO: 241 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acaccttgaaggacacctctcca

SEQ ID NO: 242 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atcaccttgaaggacacctctcc

SEQ ID NO: 243 - RNA, 23 nt, synthetic construct
  source 1..23: mol_type = other RNA; note = Description of Artificial Sequence: Synthetic oligonucleotide
actgcacaggtcctgtgggatca

SEQ ID NO: 244 - RNA, 23 nt, synthetic construct
  source 1..23: mol_type = other RNA; note = Description of Artificial Sequence: Synthetic oligonucleotide
aacacagcatgcgtggcgtcacc

SEQ ID NO: 245 - RNA, 23 nt, synthetic construct
  source 1..23: mol_type = other RNA; note = Description of Artificial Sequence: Synthetic oligonucleotide
acacacagcatgcgtggcgtcac

SEQ ID NO: 246 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
acttcttgcccttgcggtagccg

SEQ ID NO: 247 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
accttcttgcccttgcggtagcc

SEQ ID NO: 248 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agacgccgaagtagttaggccgg

SEQ ID NO: 249 - RNA, 23 nt, synthetic construct
  source 1..23: mol_type = other RNA; note = Description of Artificial Sequence: Synthetic oligonucleotide
aagacgccgaagtagttaggccg

SEQ ID NO: 250 - RNA, 23 nt, synthetic construct
  source 1..23: mol_type = other RNA; note = Description of Artificial Sequence: Synthetic oligonucleotide
acacctgtgatgcgggtgtagac

SEQ ID NO: 251 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acaccacttgctggatccagctg

SEQ ID NO: 252 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acaagatgccacctcctgccacc

SEQ ID NO: 253 - RNA, 23 nt, synthetic construct
  source 1..23: mol_type = other RNA; note = Description of Artificial Sequence: Synthetic oligonucleotide
aacaagatgccacctcctgccac

SEQ ID NO: 254 - RNA, 23 nt, synthetic construct
  source 1..23: mol_type = other RNA; note = Description of Artificial Sequence: Synthetic oligonucleotide
agacaagatgccacctcctgcca

SEQ ID NO: 255 - RNA, 23 nt, synthetic construct
  source 1..23: mol_type = other RNA; note = Description of Artificial Sequence: Synthetic oligonucleotide
aagacaagatgccacctcctgcc

SEQ ID NO: 256 - RNA, 23 nt, synthetic construct
  source 1..23: mol_type = other RNA; note = Description of Artificial Sequence: Synthetic oligonucleotide
acatcactggagcagacatcagg

SEQ ID NO: 257 - RNA, 23 nt, synthetic construct
  source 1..23: mol_type = other RNA; note = Description of Artificial Sequence: Synthetic oligonucleotide
aggacggaggagagagaattggg

SEQ ID NO: 258 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagcattcttgctgctgagccac

SEQ ID NO: 259 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acagcattcttgctgctgagcca

SEQ ID NO: 260 - RNA, 23 nt, synthetic construct
  source 1..23: mol_type = other RNA; note = Description of Artificial Sequence: Synthetic oligonucleotide
acagatcccaagttagaccaggg

SEQ ID NO: 261 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
accagatcccaagttagaccagg

SEQ ID NO: 262 - RNA, 23 nt, synthetic construct
  source 1..23: mol_type = other RNA; note = Description of Artificial Sequence: Synthetic oligonucleotide
acccagatcccaagttagaccag

SEQ ID NO: 263 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
acattcccagatcccaagttaga

SEQ ID NO: 264 - RNA, 23 nt, synthetic construct
  source 1..23: mol_type = other RNA; note = Description of Artificial Sequence: Synthetic oligonucleotide
acttccattcccagatcccaagt

SEQ ID NO: 265 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
acaccttccattcccagatccca

SEQ ID NO: 266 - RNA, 23 nt, synthetic construct
  source 1..23: mol_type = other RNA; note = Description of Artificial Sequence: Synthetic oligonucleotide
accaaagggcagctgagctcacc

SEQ ID NO: 267 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atccaaagggcagctgagctcac

SEQ ID NO: 268 - RNA, 23 nt, synthetic construct
  source 1..23: mol_type = other RNA; note = Description of Artificial Sequence: Synthetic oligonucleotide
aattccaaagggcagctgagctc

SEQ ID NO: 269 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
actttattccaaagggcagctga

SEQ ID NO: 270 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagctttattccaaagggcagct

SEQ ID NO: 271 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acagctttattccaaagggcagc

SEQ ID NO: 272 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctgtgaggactccaagagt

SEQ ID NO: 273 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtgctactctggtatttcct

SEQ ID NO: 274 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgctactctggtatttcctt

SEQ ID NO: 275 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgctactctggtatttcctat

SEQ ID NO: 276 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctactctggtatttcctagt

SEQ ID NO: 277 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctactctggtatttcctaggt

SEQ ID NO: 278 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tactctggtatttcctagggt

SEQ ID NO: 279 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
actctggtatttcctagggtt

SEQ ID NO: 280 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctctggtatttcctagggtat

SEQ ID NO: 281 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctggtatttcctagggtact

SEQ ID NO: 282 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atttcctagggtacaaggcgt

SEQ ID NO: 283 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtcagccaggtgtactcagt

SEQ ID NO: 284 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agccaggtgtactcaggcagt

SEQ ID NO: 285 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccacttctcccaggatcttt

SEQ ID NO: 286 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttctcccaggatcttacccgt

SEQ ID NO: 287 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcccaggatcttacccgccgt

SEQ ID NO: 288 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccttccgcagtgaaaccgct

SEQ ID NO: 289 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caactccagctccgtctattt

SEQ ID NO: 290 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagctccgtctattcctttgt

SEQ ID NO: 291 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctcacctgcttcttctggttt

SEQ ID NO: 292 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcacctgcttcttctggttct

SEQ ID NO: 293 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acctgcttcttctggttcatt

SEQ ID NO: 294 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctgcttcttctggttcattt

SEQ ID NO: 295 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcttcttctggttcattctt

SEQ ID NO: 296 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcttcttctggttcattctct

SEQ ID NO: 297 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cttcttctggttcattctcct

SEQ ID NO: 298 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttcttctggttcattctccat

SEQ ID NO: 299 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggttcattctccaaatcct

SEQ ID NO: 300 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acagggccgagtacgaagtgt

SEQ ID NO: 301 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagggccgagtacgaagtggt

SEQ ID NO: 302 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagtgtgaaagacatagctt

SEQ ID NO: 303 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagtgtgaaagacatagctgt

SEQ ID NO: 304 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
attgaattccacgctgggttt

SEQ ID NO: 305 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttgaattccacgctgggttgt

SEQ ID NO: 306 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgaattccacgctgggttgtt

SEQ ID NO: 307 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aattccacgctgggttgttat

SEQ ID NO: 308 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tccacgctgggttgttaccgt

SEQ ID NO: 309 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccacgctgggttgttaccgct

SEQ ID NO: 310 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cacgctgggttgttaccgctt

SEQ ID NO: 311 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgggttgttaccgctacagt

SEQ ID NO: 312 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggaccgactggccatgtatt

SEQ ID NO: 313 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggaccgactggccatgtatgt

SEQ ID NO: 314 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
accgactggccatgtatgact

SEQ ID NO: 315 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccgactggccatgtatgacgt

SEQ ID NO: 316 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gactggccatgtatgacgtgt

SEQ ID NO: 317 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
actggccatgtatgacgtggt

SEQ ID NO: 318 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggccatgtatgacgtggct

SEQ ID NO: 319 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aggctcatcacctcggtgtat

SEQ ID NO: 320 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctgcacagctactacgact

SEQ ID NO: 321 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctgcacagctactacgacct

SEQ ID NO: 322 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctctctggactacggcttgt

SEQ ID NO: 323 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctctggactacggcttggct

SEQ ID NO: 324 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tacggcttggccctctggttt

SEQ ID NO: 325 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acggcttggccctctggtttt

SEQ ID NO: 326 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cggcttggccctctggtttgt

SEQ ID NO: 327 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcttggccctctggtttgat

SEQ ID NO: 328 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaggaggcagaagtatgattt

SEQ ID NO: 329 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggaggcagaagtatgatttgt

SEQ ID NO: 330 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaggcagaagtatgatttgct

SEQ ID NO: 331 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aggcagaagtatgatttgcct

SEQ ID NO: 332 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcagaagtatgatttgccgt

SEQ ID NO: 333 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcagaagtatgatttgccgtt

SEQ ID NO: 334 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagaagtatgatttgccgtgt

SEQ ID NO: 335 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaagtatgatttgccgtgct

SEQ ID NO: 336 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaagtatgatttgccgtgcat

SEQ ID NO: 337 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagtggacgatccagaacagt

SEQ ID NO: 338 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agtggacgatccagaacaggt

SEQ ID NO: 339 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagaacaggaggctgtgtgt

SEQ ID NO: 340 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaacaggaggctgtgtggct

SEQ ID NO: 341 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgtgcgggtgcactatggctt

SEQ ID NO: 342 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgcgggtgcactatggcttt

SEQ ID NO: 343 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcgggtgcactatggcttgtt

SEQ ID NO: 344 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggtgcactatggcttgtact

SEQ ID NO: 345 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
actatggcttgtacaaccagt

SEQ ID NO: 346 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcttgtacaaccagtcggact

SEQ ID NO: 347 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgccctggagagttcctctt

SEQ ID NO: 348 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctggatgagagaaactgct

SEQ ID NO: 349 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggatgagagaaactgcgttt

SEQ ID NO: 350 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggatgagagaaactgcgtttt

SEQ ID NO: 351 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagagaaactgcgtttgcagt

SEQ ID NO: 352 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tttgcagagccacattccagt

SEQ ID NO: 353 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgggacattcaccttccagt

SEQ ID NO: 354 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgggacattcaccttccagtt

SEQ ID NO: 355 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggacattcaccttccagtgtt

SEQ ID NO: 356 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gacattcaccttccagtgtgt

SEQ ID NO: 357 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acattcaccttccagtgtgat

SEQ ID NO: 358 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cattcaccttccagtgtgagt

SEQ ID NO: 359 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atcgctgaccgctgggtgatt

SEQ ID NO: 360 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgaccgctgggtgataacagt

SEQ ID NO: 361 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgtgttcctgggcaaggtgtt

SEQ ID NO: 362 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgttcctgggcaaggtgtgt

SEQ ID NO: 363 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcaaggtgtggcagaactcgt

SEQ ID NO: 364 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aaggtgtggcagaactcgcgt

SEQ ID NO: 365 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggagaggtgtccttcaagt

SEQ ID NO: 366 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggagaggtgtccttcaaggt

SEQ ID NO: 367 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagaggtgtccttcaaggtgt

SEQ ID NO: 368 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaggtgtccttcaaggtgat

SEQ ID NO: 369 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atcccacaggacctgtgcagt

SEQ ID NO: 370 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgacgccacgcatgctgtgtt

SEQ ID NO: 371 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate
gacgccacgcatgctgtgtgt

SEQ ID NO: 372 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctaccgcaagggcaagaagt

SEQ ID NO: 373 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctaccgcaagggcaagaaggt

SEQ ID NO: 374 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcctaactacttcggcgtct

SEQ ID NO: 375 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctaactacttcggcgtctt

SEQ ID NO: 376 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctacacccgcatcacaggtgt

SEQ ID NO: 377 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctggatccagcaagtggtgt

SEQ ID NO: 378 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggcaggaggtggcatcttgt

SEQ ID NO: 379 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcaggaggtggcatcttgtt

SEQ ID NO: 380 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcaggaggtggcatcttgtct

SEQ ID NO: 381 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caggaggtggcatcttgtctt

SEQ ID NO: 382 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgatgtctgctccagtgatgt

SEQ ID NO: 383 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caattctctctcctccgtcct

SEQ ID NO: 384 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggctcagcagcaagaatgctt

SEQ ID NO: 385 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctcagcagcaagaatgctgt

SEQ ID NO: 386 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggtctaacttgggatctgt

SEQ ID NO: 387 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggtctaacttgggatctggt

SEQ ID NO: 388 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtctaacttgggatctgggt

SEQ ID NO: 389 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
taacttgggatctgggaatgt

SEQ ID NO: 390 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttgggatctgggaatggaagt

SEQ ID NO: 391 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggatctgggaatggaaggtgt

SEQ ID NO: 392 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgagctcagctgccctttggt

SEQ ID NO: 393 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagctcagctgccctttggat

SEQ ID NO: 394 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctcagctgccctttggaatt

SEQ ID NO: 395 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agctgccctttggaataaagt

SEQ ID NO: 396 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgccctttggaataaagctt

SEQ ID NO: 397 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgccctttggaataaagctgt

SEQ ID NO: 398 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actcttggagtcctcacaggcct

SEQ ID NO: 399 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggaaataccagagtagcacccc

SEQ ID NO: 400 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaggaaataccagagtagcaccc

SEQ ID NO: 401 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataggaaataccagagtagcacc

SEQ ID NO: 402 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actaggaaataccagagtagcac

SEQ ID NO: 403 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acctaggaaataccagagtagca

SEQ ID NO: 404 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accctaggaaataccagagtagc

SEQ ID NO: 405 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaccctaggaaataccagagtag

SEQ ID NO: 406 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataccctaggaaataccagagta

SEQ ID NO: 407 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtaccctaggaaataccagagt

SEQ ID NO: 408 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgccttgtaccctaggaaatac

SEQ ID NO: 409 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgagtacacctggctgaccat

SEQ ID NO: 410 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgcctgagtacacctggctga

SEQ ID NO: 411 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagatcctgggagaagtggcga

SEQ ID NO: 412 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgggtaagatcctgggagaagt

SEQ ID NO: 413 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acggcgggtaagatcctgggaga

SEQ ID NO: 414 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcggtttcactgcggaaggcac

SEQ ID NO: 415 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaatagacggagctggagttgta

SEQ ID NO: 416 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaaggaatagacggagctgga

SEQ ID NO: 417 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaccagaagaagcaggtgaggg

SEQ ID NO: 418 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaaccagaagaagcaggtgagg

SEQ ID NO: 419 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatgaaccagaagaagcaggtga

SEQ ID NO: 420 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaatgaaccagaagaagcaggtg

SEQ ID NO: 421 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagaatgaaccagaagaagcagg

SEQ ID NO: 422 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagaatgaaccagaagaagcag

SEQ ID NO: 423 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggagaatgaaccagaagaagca

SEQ ID NO: 424 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggagaatgaaccagaagaagc

SEQ ID NO: 425 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggatttggagaatgaaccagaa

SEQ ID NO: 426 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacttcgtactcggccctgtag

SEQ ID NO: 427 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accacttcgtactcggccctgta

SEQ ID NO: 428 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagctatgtctttcacactggct

SEQ ID NO: 429 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagctatgtctttcacactggc

SEQ ID NO: 430 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacccagcgtggaattcaatgc

SEQ ID NO: 431 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaacccagcgtggaattcaatg

SEQ ID NO: 432 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaacccagcgtggaattcaat

SEQ ID NO: 433 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataacaacccagcgtggaattca

SEQ ID NO: 434 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acggtaacaacccagcgtggaat

SEQ ID NO: 435 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcggtaacaacccagcgtggaa

SEQ ID NO: 436 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagcggtaacaacccagcgtgga

SEQ ID NO: 437 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgtagcggtaacaacccagcg

SEQ ID NO: 438 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatacatggccagtcggtcccgg

SEQ ID NO: 439 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatacatggccagtcggtcccg

SEQ ID NO: 440 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcatacatggccagtcggtcc

SEQ ID NO: 441 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgtcatacatggccagtcggtc

SEQ ID NO: 442 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacgtcatacatggccagtcgg

SEQ ID NO: 443 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accacgtcatacatggccagtcg

SEQ ID NO: 444 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccacgtcatacatggccagtc

SEQ ID NO: 445 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atacaccgaggtgatgagcctct

SEQ ID NO: 446 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcgtagtagctgtgcaggccc

SEQ ID NO: 447 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtcgtagtagctgtgcaggcc

SEQ ID NO: 448 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaagccgtagtccagagagggc

SEQ ID NO: 449 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccaagccgtagtccagagagg

SEQ ID NO: 450 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaccagagggccaagccgtagt

SEQ ID NO: 451 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaaccagagggccaagccgtag

SEQ ID NO: 452 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaaccagagggccaagccgta

SEQ ID NO: 453 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcaaaccagagggccaagccgt

SEQ ID NO: 454 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaatcatacttctgcctcctcag

SEQ ID NO: 455 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaatcatacttctgcctcctc

SEQ ID NO: 456 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcaaatcatacttctgcctcct

SEQ ID NO: 457 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggcaaatcatacttctgcctcc

SEQ ID NO: 458 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acggcaaatcatacttctgcctc

SEQ ID NO: 459 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacggcaaatcatacttctgcct

SEQ ID NO: 460 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacggcaaatcatacttctgcc

SEQ ID NO: 461 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcacggcaaatcatacttctgc

SEQ ID NO: 462 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgcacggcaaatcatacttctg

SEQ ID NO: 463 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgttctggatcgtccactggc

SEQ ID NO: 464 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acctgttctggatcgtccactgg

SEQ ID NO: 465 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacacagcctcctgttctggat

SEQ ID NO: 466 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccacacagcctcctgttctgg

SEQ ID NO: 467 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagccatagtgcacccgcacacc

SEQ ID NO: 468 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagccatagtgcacccgcacac

SEQ ID NO: 469 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaagccatagtgcacccgcac

SEQ ID NO: 470 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtacaagccatagtgcacccgc

SEQ ID NO: 471 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actggttgtacaagccatagtgc

SEQ ID NO: 472 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtccgactggttgtacaagcca

SEQ ID NO: 473 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagaggaactctccagggcaggg

SEQ ID NO: 474 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcagtttctctcatccaggccg

SEQ ID NO: 475 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacgcagtttctctcatccagg

SEQ ID NO: 476 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaacgcagtttctctcatccag

SEQ ID NO: 477 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgcaaacgcagtttctctcat

SEQ ID NO: 478 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actggaatgtggctctgcaaacg

SEQ ID NO: 479 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actggaaggtgaatgtcccacat

SEQ ID NO: 480 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aactggaaggtgaatgtcccaca

SEQ ID NO: 481 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacactggaaggtgaatgtccca

SEQ ID NO: 482 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacactggaaggtgaatgtccc

SEQ ID NO: 483 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcacactggaaggtgaatgtcc

SEQ ID NO: 484 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actcacactggaaggtgaatgtc

SEQ ID NO: 485 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcacccagcggtcagcgatga

SEQ ID NO: 486 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgttatcacccagcggtcagc

SEQ ID NO: 487 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaccttgcccaggaacacggt

SEQ ID NO: 488 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacaccttgcccaggaacacgg

SEQ ID NO: 489 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgagttctgccacaccttgccc

SEQ ID NO: 490 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgcgagttctgccacaccttgc

SEQ ID NO: 491 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgaaggacacctctccaggc

SEQ ID NO: 492 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accttgaaggacacctctccagg

SEQ ID NO: 493 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaccttgaaggacacctctcca

SEQ ID NO: 494 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcaccttgaaggacacctctcc

SEQ ID NO: 495 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgcacaggtcctgtgggatca

SEQ ID NO: 496 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacacagcatgcgtggcgtcacc

SEQ ID NO: 497 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacacagcatgcgtggcgtcac

SEQ ID NO: 498 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttcttgcccttgcggtagccg

SEQ ID NO: 499 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accttcttgcccttgcggtagcc

SEQ ID NO: 500 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacgccgaagtagttaggccgg

SEQ ID NO: 501 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacgccgaagtagttaggccg

SEQ ID NO: 502 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacctgtgatgcgggtgtagac

SEQ ID NO: 503 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaccacttgctggatccagctg

SEQ ID NO: 504 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaagatgccacctcctgccacc

SEQ ID NO: 505 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaagatgccacctcctgccac

SEQ ID NO: 506 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacaagatgccacctcctgcca

SEQ ID NO: 507 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacaagatgccacctcctgcc

SEQ ID NO: 508 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatcactggagcagacatcagg

SEQ ID NO: 509 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggacggaggagagagaattggg

SEQ ID NO: 510 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagcattcttgctgctgagccac

SEQ ID NO: 511 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagcattcttgctgctgagcca

SEQ ID NO: 512 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagatcccaagttagaccaggg

SEQ ID NO: 513 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accagatcccaagttagaccagg

SEQ ID NO: 514 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acccagatcccaagttagaccag

SEQ ID NO: 515 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acattcccagatcccaagttaga

SEQ ID NO: 516 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttccattcccagatcccaagt

SEQ ID NO: 517 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaccttccattcccagatccca

SEQ ID NO: 518 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accaaagggcagctgagctcacc

SEQ ID NO: 519 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccaaagggcagctgagctcac

SEQ ID NO: 520 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattccaaagggcagctgagctc

SEQ ID NO: 521 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actttattccaaagggcagctga

SEQ ID NO: 522 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagctttattccaaagggcagct

SEQ ID NO: 523 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagctttattccaaagggcagc

SEQ ID NO: 524 - RNA, 23 nt, Homo sapiens
  source 1..23: mol_type = unassigned RNA
aggcctgtgaggactccaagaga

SEQ ID NO: 525 - RNA, 23 nt, Homo sapiens
  source 1..23: mol_type = unassigned RNA
ggggtgctactctggtatttcct

SEQ ID NO: 526 - RNA, 23 nt, Homo sapiens
  source 1..23: mol_type = unassigned RNA
gggtgctactctggtatttccta

SEQ ID NO: 527 - RNA, 23 nt, Homo sapiens
  source 1..23: mol_type = unassigned RNA
ggtgctactctggtatttcctag

SEQ ID NO: 528 - RNA, 23 nt, Homo sapiens
  source 1..23: mol_type = unassigned RNA
gtgctactctggtatttcctagg

SEQ ID NO: 529 - RNA, 23 nt, Homo sapiens
  source 1..23: mol_type = unassigned RNA
tgctactctggtatttcctaggg

SEQ ID NO: 530 - RNA, 23 nt, Homo sapiens
  source 1..23: mol_type = unassigned RNA
gctactctggtatttcctagggt

SEQ ID NO: 531 - RNA, 23 nt, Homo sapiens
  source 1..23: mol_type = unassigned RNA
ctactctggtatttcctagggta

SEQ ID NO: 532 - RNA, 23 nt, Homo sapiens
  source 1..23: mol_type = unassigned RNA
tactctggtatttcctagggtac

SEQ ID NO: 533 - RNA, 23 nt, Homo sapiens
  source 1..23: mol_type = unassigned RNA
actctggtatttcctagggtaca

SEQ ID NO: 534 - RNA, 23 nt, Homo sapiens
  source 1..23: mol_type = unassigned RNA
gtatttcctagggtacaaggcgg

SEQ ID NO: 535 - RNA, 23 nt, Homo sapiens
  source 1..23: mol_type = unassigned RNA
atggtcagccaggtgtactcagg

SEQ ID NO: 536 - RNA, 23 nt, Homo sapiens
  source 1..23: mol_type = unassigned RNA
tcagccaggtgtactcaggcagt

SEQ ID NO: 537 - RNA, 23 nt, Homo sapiens
  source 1..23: mol_type = unassigned RNA
tcgccacttctcccaggatctta

SEQ ID NO: 538 - RNA, 23 nt, Homo sapiens
  source 1..23: mol_type = unassigned RNA
acttctcccaggatcttacccgc

SEQ ID NO: 539 - RNA, 23 nt, Homo sapiens
  source 1..23: mol_type = unassigned RNA
tctcccaggatcttacccgccgg

SEQ ID NO: 540 - RNA, 23 nt, Homo sapiens
  source 1..23: mol_type = unassigned RNA
gtgccttccgcagtgaaaccgcc

SEQ ID NO: 541 - RNA, 23 nt, Homo sapiens
  source 1..23: mol_type = unassigned RNA
tacaactccagctccgtctattc

SEQ ID NO: 542 - RNA, 23 nt, Homo sapiens
  source 1..23: mol_type = unassigned RNA
tccagctccgtctattcctttgg

SEQ ID NO: 543 - RNA, 23 nt, Homo sapiens
  source 1..23: mol_type = unassigned RNA
ccctcacctgcttcttctggttc

SEQ ID NO: 544 - RNA, 23 nt, Homo sapiens
  source 1..23: mol_type = unassigned RNA
cctcacctgcttcttctggttca

SEQ ID NO: 545 - RNA, 23 nt, Homo sapiens
  source 1..23: mol_type = unassigned RNA
tcacctgcttcttctggttcatt

SEQ ID NO: 546 - RNA, 23 nt, Homo sapiens
  source 1..23: mol_type = unassigned RNA
cacctgcttcttctggttcattc

SEQ ID NO: 547 - RNA, 23 nt, Homo sapiens
  source 1..23: mol_type = unassigned RNA
cctgcttcttctggttcattctc

SEQ ID NO: 548 - RNA, 23 nt, Homo sapiens
  source 1..23: mol_type = unassigned RNA
ctgcttcttctggttcattctcc

SEQ ID NO: 549 - RNA, 23 nt, Homo sapiens
  source 1..23: mol_type = unassigned RNA
tgcttcttctggttcattctcca

SEQ ID NO: 550 - RNA, 23 nt, Homo sapiens
  source 1..23: mol_type = unassigned RNA
gcttcttctggttcattctccaa

SEQ ID NO: 551 - RNA, 23 nt, Homo sapiens
  source 1..23: mol_type = unassigned RNA
ttctggttcattctccaaatccc

SEQ ID NO: 552 - RNA, 23 nt, Homo sapiens
  source 1..23: mol_type = unassigned RNA
ctacagggccgagtacgaagtgg

SEQ ID NO: 553 - RNA, 23 nt, Homo sapiens
  source 1..23: mol_type = unassigned RNA
tacagggccgagtacgaagtgga

SEQ ID NO: 554 - RNA, 23 nt, Homo sapiens
  source 1..23: mol_type = unassigned RNA
agccagtgtgaaagacatagctg

SEQ ID NO: 555 - RNA, 23 nt, Homo sapiens
  source 1..23: mol_type = unassigned RNA
gccagtgtgaaagacatagctgc

SEQ ID NO: 556 - RNA, 23 nt, Homo sapiens
  source 1..23: mol_type = unassigned RNA
gcattgaattccacgctgggttg

SEQ ID NO: 557 - RNA, 23 nt, Homo sapiens
  source 1..23: mol_type = unassigned RNA
cattgaattccacgctgggttgt

SEQ ID NO: 558 - RNA, 23 nt, Homo sapiens
  source 1..23: mol_type = unassigned RNA
attgaattccacgctgggttgtt

SEQ ID NO: 559 - RNA, 23 nt, Homo sapiens
  source 1..23: mol_type = unassigned RNA
tgaattccacgctgggttgttac

SEQ ID NO: 560 - RNA, 23 nt, Homo sapiens
  source 1..23: mol_type = unassigned RNA
attccacgctgggttgttaccgc

SEQ ID NO: 561 - RNA, 23 nt, Homo sapiens
  source 1..23: mol_type = unassigned RNA
ttccacgctgggttgttaccgct

SEQ ID NO: 562 - RNA, 23 nt, Homo sapiens
  source 1..23: mol_type = unassigned RNA
tccacgctgggttgttaccgcta

SEQ ID NO: 563 - RNA, 23 nt, Homo sapiens
  source 1..23: mol_type = unassigned RNA
cgctgggttgttaccgctacagc

SEQ ID NO: 564 - RNA, 23 nt, Homo sapiens
  source 1..23: mol_type = unassigned RNA
ccgggaccgactggccatgtatg

SEQ ID NO: 565 - RNA, 23 nt, Homo sapiens
  source 1..23: mol_type = unassigned RNA
cgggaccgactggccatgtatga

SEQ ID NO: 566 - RNA, 23 nt, Homo sapiens
  source 1..23: mol_type = unassigned RNA
ggaccgactggccatgtatgacg

SEQ ID NO: 567 - RNA, 23 nt, Homo sapiens
  source 1..23: mol_type = unassigned RNA
gaccgactggccatgtatgacgt

SEQ ID NO: 568 - RNA, 23 nt, Homo sapiens
  source 1..23: mol_type = unassigned RNA
ccgactggccatgtatgacgtgg

SEQ ID NO: 569 - RNA, 23 nt, Homo sapiens
  source 1..23: mol_type = unassigned RNA
cgactggccatgtatgacgtggc

SEQ ID NO: 570 - RNA, 23 nt, Homo sapiens
  source 1..23: mol_type = unassigned RNA
gactggccatgtatgacgtggcc

SEQ ID NO: 571 - RNA, 23 nt, Homo sapiens
  source 1..23: mol_type = unassigned RNA
agaggctcatcacctcggtgtac

SEQ ID NO: 572 - RNA, 23 nt, Homo sapiens
  source 1..23: mol_type = unassigned RNA
gggcctgcacagctactacgacc

SEQ ID NO: 573 - RNA, 23 nt, Homo sapiens
  source 1..23: mol_type = unassigned RNA
ggcctgcacagctactacgaccc

SEQ ID NO: 574 - RNA, 23 nt, Homo sapiens
  source 1..23: mol_type = unassigned RNA
gccctctctggactacggcttgg

SEQ ID NO: 575 - RNA, 23 nt, Homo sapiens
  source 1..23: mol_type = unassigned RNA
cctctctggactacggcttggcc

SEQ ID NO: 576 - RNA, 23 nt, Homo sapiens
  source 1..23: mol_type = unassigned RNA
actacggcttggccctctggttt

SEQ ID NO: 577 - RNA, 23 nt, Homo sapiens
  source 1..23: mol_type = unassigned RNA
ctacggcttggccctctggtttg

SEQ ID NO: 578 - RNA, 23 nt, Homo sapiens
  source 1..23: mol_type = unassigned RNA
tacggcttggccctctggtttga

SEQ ID NO: 579 - RNA, 23 nt, Homo sapiens
  source 1..23: mol_type = unassigned RNA
acggcttggccctctggtttgat

SEQ ID NO: 580 - RNA, 23 nt, Homo sapiens
  source 1..23: mol_type = unassigned RNA
ctgaggaggcagaagtatgattt

SEQ ID NO: 581 - RNA, 23 nt, Homo sapiens
  source 1..23: mol_type = unassigned RNA
gaggaggcagaagtatgatttgc

SEQ ID NO: 582 - RNA, 23 nt, Homo sapiens
  source 1..23: mol_type = unassigned RNA
aggaggcagaagtatgatttgcc

SEQ ID NO: 583 - RNA, 23 nt, Homo sapiens
  source 1..23: mol_type = unassigned RNA
ggaggcagaagtatgatttgccg

SEQ ID NO: 584 - RNA, 23 nt, Homo sapiens
  source 1..23: mol_type = unassigned RNA
gaggcagaagtatgatttgccgt

SEQ ID NO: 585 - RNA, 23 nt, Homo sapiens
  source 1..23: mol_type = unassigned RNA
aggcagaagtatgatttgccgtg

SEQ ID NO: 586 - RNA, 23 nt, Homo sapiens
  source 1..23: mol_type = unassigned RNA
ggcagaagtatgatttgccgtgc

SEQ ID NO: 587 - RNA, 23 nt, Homo sapiens
  source 1..23: mol_type = unassigned RNA
gcagaagtatgatttgccgtgca

SEQ ID NO: 588 - RNA, 23 nt, Homo sapiens
  source 1..23: mol_type = unassigned RNA
cagaagtatgatttgccgtgcac

SEQ ID NO: 589 - RNA, 23 nt, Homo sapiens
  source 1..23: mol_type = unassigned RNA
gccagtggacgatccagaacagg

SEQ ID NO: 590 - RNA, 23 nt, Homo sapiens
  source 1..23: mol_type = unassigned RNA
ccagtggacgatccagaacagga

SEQ ID NO: 591 - RNA, 23 nt, Homo sapiens
  source 1..23: mol_type = unassigned RNA
atccagaacaggaggctgtgtgg

SEQ ID NO: 592 - RNA, 23 nt, Homo sapiens
  source 1..23: mol_type = unassigned RNA
ccagaacaggaggctgtgtggct

SEQ ID NO: 593 - RNA, 23 nt, Homo sapiens
  source 1..23: mol_type = unassigned RNA
ggtgtgcgggtgcactatggctt

SEQ ID NO: 594 - RNA, 23 nt, Homo sapiens
  source 1..23: mol_type = unassigned RNA
gtgtgcgggtgcactatggcttg

SEQ ID NO: 595 - RNA, 23 nt, Homo sapiens
  source 1..23: mol_type = unassigned RNA
gtgcgggtgcactatggcttgta

SEQ ID NO: 596 - RNA, 23 nt, Homo sapiens
  source 1..23: mol_type = unassigned RNA
gcgggtgcactatggcttgtaca

SEQ ID NO: 597 - RNA, 23 nt, Homo sapiens
  source 1..23: mol_type = unassigned RNA
gcactatggcttgtacaaccagt

SEQ ID NO: 598 - RNA, 23 nt, Homo sapiens
  source 1..23: mol_type = unassigned RNA
tggcttgtacaaccagtcggacc

SEQ ID NO: 599 - RNA, 23 nt, Homo sapiens
  source 1..23: mol_type = unassigned RNA
ccctgccctggagagttcctctg

SEQ ID NO: 600 - RNA, 23 nt, Homo sapiens
  source 1..23: mol_type = unassigned RNA
cggcctggatgagagaaactgcg

SEQ ID NO: 601 - RNA, 23 nt, Homo sapiens
  source 1..23: mol_type = unassigned RNA
cctggatgagagaaactgcgttt

SEQ ID NO: 602 - RNA, 23 nt, Homo sapiens
  source 1..23: mol_type = unassigned RNA
ctggatgagagaaactgcgtttg

SEQ ID NO: 603 - RNA, 23 nt, Homo sapiens
  source 1..23: mol_type = unassigned RNA
atgagagaaactgcgtttgcaga

SEQ ID NO: 604 - RNA, 23 nt, Homo sapiens
  source 1..23: mol_type = unassigned RNA
cgtttgcagagccacattccagt

SEQ ID NO: 605 - RNA, 23 nt, Homo sapiens
  source 1..23: mol_type = unassigned RNA
atgtgggacattcaccttccagt

SEQ ID NO: 606 - RNA, 23 nt, Homo sapiens
  source 1..23: mol_type = unassigned RNA
tgtgggacattcaccttccagtg

SEQ ID NO: 607 - RNA, 23 nt, Homo sapiens
  source 1..23: mol_type = unassigned RNA
tgggacattcaccttccagtgtg

SEQ ID NO: 608 - RNA, 23 nt, Homo sapiens
  source 1..23: mol_type = unassigned RNA
gggacattcaccttccagtgtga

SEQ ID NO: 609 - RNA, 23 nt, Homo sapiens
  source 1..23: mol_type = unassigned RNA
ggacattcaccttccagtgtgag

SEQ ID NO: 610 - RNA, 23 nt, Homo sapiens
  source 1..23: mol_type = unassigned RNA
gacattcaccttccagtgtgagg

SEQ ID NO: 611 - RNA, 23 nt, Homo sapiens
  source 1..23: mol_type = unassigned RNA
tcatcgctgaccgctgggtgata

SEQ ID NO: 612 - RNA, 23 nt, Homo sapiens
  source 1..23: mol_type = unassigned RNA
gctgaccgctgggtgataacagc

SEQ ID NO: 613 - RNA, 23 nt, Homo sapiens
  source 1..23: mol_type = unassigned RNA
accgtgttcctgggcaaggtgtg

SEQ ID NO: 614 - RNA, 23 nt, Homo sapiens
  source 1..23: mol_type = unassigned RNA
ccgtgttcctgggcaaggtgtgg

SEQ ID NO: 615 - RNA, 23 nt, Homo sapiens
  source 1..23: mol_type = unassigned RNA
gggcaaggtgtggcagaactcgc

SEQ ID NO: 616 - RNA, 23 nt, Homo sapiens
  source 1..23: mol_type = unassigned RNA
gcaaggtgtggcagaactcgcgc

SEQ ID NO: 617 - RNA, 23 nt, Homo sapiens
  source 1..23: mol_type = unassigned RNA
gcctggagaggtgtccttcaagg

SEQ ID NO: 618 - RNA, 23 nt, Homo sapiens
  source 1..23: mol_type = unassigned RNA
cctggagaggtgtccttcaaggt

SEQ ID NO: 619 - RNA, 23 nt, Homo sapiens
  source 1..23: mol_type = unassigned RNA
tggagaggtgtccttcaaggtga

SEQ ID NO: 620 - RNA, 23 nt, Homo sapiens
  source 1..23: mol_type = unassigned RNA
ggagaggtgtccttcaaggtgag

SEQ ID NO: 621 - RNA, 23 nt, Homo sapiens
  source 1..23: mol_type = unassigned RNA
tgatcccacaggacctgtgcagc

SEQ ID NO: 622 - RNA, 23 nt, Homo sapiens
  source 1..23: mol_type = unassigned RNA
ggtgacgccacgcatgctgtgtg

SEQ ID NO: 623 - RNA, 23 nt, Homo sapiens
  source 1..23: mol_type = unassigned RNA
gtgacgccacgcatgctgtgtgc

SEQ ID NO: 624 - RNA, 23 nt, Homo sapiens
  source 1..23: mol_type = unassigned RNA
cggctaccgcaagggcaagaagg

SEQ ID NO: 625 - RNA, 23 nt, Homo sapiens
  source 1..23: mol_type = unassigned RNA
ggctaccgcaagggcaagaagga

SEQ ID NO: 626 - RNA, 23 nt, Homo sapiens
  source 1..23: mol_type = unassigned RNA
ccggcctaactacttcggcgtct

SEQ ID NO: 627 - RNA, 23 nt, Homo sapiens
  source 1..23: mol_type = unassigned RNA
cggcctaactacttcggcgtcta

SEQ ID NO: 628 - RNA, 23 nt, Homo sapiens
  source 1..23: mol_type = unassigned RNA
gtctacacccgcatcacaggtgt

SEQ ID NO: 629 - RNA, 23 nt, Homo sapiens
  source 1..23: mol_type = unassigned RNA
cagctggatccagcaagtggtga

SEQ ID NO: 630 - RNA, 23 nt, Homo sapiens
  source 1..23: mol_type = unassigned RNA
ggtggcaggaggtggcatcttgt

SEQ ID NO: 631 - RNA, 23 nt, Homo sapiens
  source 1..23: mol_type = unassigned RNA
gtggcaggaggtggcatcttgtc

SEQ ID NO: 632 - RNA, 23 nt, Homo sapiens
  source 1..23: mol_type = unassigned RNA
tggcaggaggtggcatcttgtct

SEQ ID NO: 633 - RNA, 23 nt, Homo sapiens
  source 1..23: mol_type = unassigned RNA
ggcaggaggtggcatcttgtctc

SEQ ID NO: 634 - RNA, 23 nt, Homo sapiens
  source 1..23: mol_type = unassigned RNA
cctgatgtctgctccagtgatgg

SEQ ID NO: 635 - RNA, 23 nt, Homo sapiens
  source 1..23: mol_type = unassigned RNA
cccaattctctctcctccgtccc

SEQ ID NO: 636 - RNA, 23 nt, Homo sapiens
  source 1..23: mol_type = unassigned RNA
gtggctcagcagcaagaatgctg

SEQ ID NO: 637 - RNA, 23 nt, Homo sapiens
  source 1..23: mol_type = unassigned RNA
tggctcagcagcaagaatgctgg

SEQ ID NO: 638 - RNA, 23 nt, Homo sapiens
  source 1..23: mol_type = unassigned RNA
ccctggtctaacttgggatctgg

SEQ ID NO: 639 - RNA, 23 nt, Homo sapiens
  source 1..23: mol_type = unassigned RNA
cctggtctaacttgggatctggg

SEQ ID NO: 640 - RNA, 23 nt, Homo sapiens
  source 1..23: mol_type = unassigned RNA
ctggtctaacttgggatctggga

SEQ ID NO: 641 - RNA, 23 nt, Homo sapiens
  source 1..23: mol_type = unassigned RNA
tctaacttgggatctgggaatgg

SEQ ID NO: 642 - RNA, 23 nt, Homo sapiens
  source 1..23: mol_type = unassigned RNA
acttgggatctgggaatggaagg

SEQ ID NO: 643 - RNA, 23 nt, Homo sapiens
  source 1..23: mol_type = unassigned RNA
tgggatctgggaatggaaggtgc

SEQ ID NO: 644 - RNA, 23 nt, Homo sapiens
  source 1..23: mol_type = unassigned RNA
ggtgagctcagctgccctttgga

SEQ ID NO: 645 - RNA, 23 nt, Homo sapiens
  source 1..23: mol_type = unassigned RNA
gtgagctcagctgccctttggaa

SEQ ID NO: 646 - RNA, 23 nt, Homo sapiens
  source 1..23: mol_type = unassigned RNA
gagctcagctgccctttggaata

SEQ ID NO: 647 - RNA, 23 nt, Homo sapiens
  source 1..23: mol_type = unassigned RNA
tcagctgccctttggaataaagc

SEQ ID NO: 648 - RNA, 23 nt, Homo sapiens
  source 1..23: mol_type = unassigned RNA
agctgccctttggaataaagctg

SEQ ID NO: 649 - RNA, 23 nt, Homo sapiens
  source 1..23: mol_type = unassigned RNA
gctgccctttggaataaagctgc

SEQ ID NO: 650 - RNA, 21 nt, synthetic construct
  source 1..21: mol_type = other RNA; note = Description of Artificial Sequence: Synthetic oligonucleotide
cggaggtgatggcgaggaagt

SEQ ID NO: 651 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ggaggtgatggcgaggaagct

SEQ ID NO: 652 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
aaggcctgtgaggactccaat

SEQ ID NO: 653 - RNA, 21 nt, synthetic construct
  source 1..21: mol_type = other RNA; note = Description of Artificial Sequence: Synthetic oligonucleotide
ggcctgtgaggactccaagat

SEQ ID NO: 654 - RNA, 21 nt, synthetic construct
  source 1..21: mol_type = other RNA; note = Description of Artificial Sequence: Synthetic oligonucleotide
cctgtgaggactccaagagat

SEQ ID NO: 655 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ctgtgaggactccaagagaat

SEQ ID NO: 656 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
ctctggtatttcctagggtat

SEQ ID NO: 657 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tctggtatttcctagggtact

SEQ ID NO: 658 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctggtatttcctagggtacat

SEQ ID NO: 659 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
tggtatttcctagggtacaat

SEQ ID NO: 660 - RNA, 21 nt, synthetic construct
  source 1..21: mol_type = other RNA; note = Description of Artificial Sequence: Synthetic oligonucleotide
ggtatttcctagggtacaagt

SEQ ID NO: 661 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gtatttcctagggtacaaggt

SEQ ID NO: 662 - RNA, 21 nt, synthetic construct
  source 1..21: mol_type = other RNA; note = Description of Artificial Sequence: Synthetic oligonucleotide
ctagggtacaaggcggaggtt

SEQ ID NO: 663 - RNA, 21 nt, synthetic construct
  source 1..21: mol_type = other RNA; note = Description of Artificial Sequence: Synthetic oligonucleotide
atggtcagccaggtgtactct

SEQ ID NO: 664 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gtcagccaggtgtactcaggt

SEQ ID NO: 665 - RNA, 21 nt, synthetic construct
  source 1..21: mol_type = other RNA; note = Description of Artificial Sequence: Synthetic oligonucleotide
tcagccaggtgtactcaggct

SEQ ID NO: 666 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
cagccaggtgtactcaggcat

SEQ ID NO: 667 - RNA, 21 nt, synthetic construct
  source 1..21: mol_type = other RNA; note = Description of Artificial Sequence: Synthetic oligonucleotide
ctcaatcgccacttctcccat

SEQ ID NO: 668 - RNA, 21 nt, synthetic construct
  source 1..21: mol_type = other RNA; note = Description of Artificial Sequence: Synthetic oligonucleotide
cgccacttctcccaggatctt

SEQ ID NO: 669 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gccacttctcccaggatcttt

SEQ ID NO: 670 - RNA, 21 nt, synthetic construct
  source 1..21: mol_type = other RNA; note = Description of Artificial Sequence: Synthetic oligonucleotide
cacttctcccaggatcttact

SEQ ID NO: 671 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
tctcccaggatcttacccgct

SEQ ID NO: 672 - RNA, 21 nt, synthetic construct
  source 1..21: mol_type = other RNA; note = Description of Artificial Sequence: Synthetic oligonucleotide
ctcccaggatcttacccgcct

SEQ ID NO: 673 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
tcccaggatcttacccgccgt

SEQ ID NO: 674 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tagtgccttccgcagtgaaat

SEQ ID NO: 675 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ccttccgcagtgaaaccgcct

SEQ ID NO: 676 - RNA, 21 nt, synthetic construct
  source 1..21: mol_type = other RNA; note = Description of Artificial Sequence: Synthetic oligonucleotide
cttccgcagtgaaaccgccat

SEQ ID NO: 677 - RNA, 21 nt, synthetic construct
  source 1..21: mol_type = other RNA; note = Description of Artificial Sequence: Synthetic oligonucleotide
ccgcagtgaaaccgccaaagt

SEQ ID NO: 678 - RNA, 21 nt, synthetic construct
  source 1..21: mol_type = other RNA; note = Description of Artificial Sequence: Synthetic oligonucleotide
cgcagtgaaaccgccaaagct

SEQ ID NO: 679 - RNA, 21 nt, synthetic construct
  source 1..21: mol_type = other RNA; note = Description of Artificial Sequence: Synthetic oligonucleotide
gcagtgaaaccgccaaagcct

SEQ ID NO: 680 - RNA, 21 nt, synthetic construct
  source 1..21: mol_type = other RNA; note = Description of Artificial Sequence: Synthetic oligonucleotide
cagtgaaaccgccaaagccct

SEQ ID NO: 681 - RNA, 21 nt, synthetic construct
  source 1..21: mol_type = other RNA; note = Description of Artificial Sequence: Synthetic oligonucleotide
agtgaaaccgccaaagcccat

SEQ ID NO: 682 - RNA, 21 nt, synthetic construct
  source 1..21: mol_type = other RNA; note = Description of Artificial Sequence: Synthetic oligonucleotide
cgccaaagcccagaagatgct

SEQ ID NO: 683 - RNA, 21 nt, synthetic construct
  source 1..21: mol_type = other RNA; note = Description of Artificial Sequence: Synthetic oligonucleotide
gccaaagcccagaagatgctt

SEQ ID NO: 684 - RNA, 21 nt, synthetic construct
  source 1..21: mol_type = other RNA; note = Description of Artificial Sequence: Synthetic oligonucleotide
agcccagaagatgctcaaggt

SEQ ID NO: 685 - RNA, 21 nt, synthetic construct
  source 1..21: mol_type = other RNA; note = Description of Artificial Sequence: Synthetic oligonucleotide
cagcacccgcctgggaacttt

SEQ ID NO: 686 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
agcacccgcctgggaacttat

SEQ ID NO: 687 - RNA, 21 nt, synthetic construct
  source 1..21: mol_type = other RNA; note = Description of Artificial Sequence: Synthetic oligonucleotide
acaactccagctccgtctatt

SEQ ID NO: 688 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
caactccagctccgtctattt

SEQ ID NO: 689 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tcacctgcttcttctggttct

SEQ ID NO: 690 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
cacctgcttcttctggttcat

SEQ ID NO: 691 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
cctgcttcttctggttcattt

SEQ ID NO: 692 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
ctgcttcttctggttcattct

SEQ ID NO: 693 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cttcttctggttcattctcct

SEQ ID NO: 694 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ttcttctggttcattctccat

SEQ ID NO: 695 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tcttctggttcattctccaat

SEQ ID NO: 696 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
cttctggttcattctccaaat

SEQ ID NO: 697 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ttctggttcattctccaaatt

SEQ ID NO: 698 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
tctggttcattctccaaatct

SEQ ID NO: 699 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctggttcattctccaaatcct

SEQ ID NO: 700 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gtggaggagctgctgtccact

SEQ ID NO: 701 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gaggagctgctgtccacagtt

SEQ ID NO: 702 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
agctgctgtccacagtcaact

SEQ ID NO: 703 - RNA, 21 nt, synthetic construct
  source 1..21: mol_type = other RNA; note = Description of Artificial Sequence: Synthetic oligonucleotide
gctgctgtccacagtcaacat

SEQ ID NO: 704 - RNA, 21 nt, synthetic construct
  source 1..21: mol_type = other RNA; note = Description of Artificial Sequence: Synthetic oligonucleotide
gctgtccacagtcaacagctt

SEQ ID NO: 705 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ctgtccacagtcaacagctct

SEQ ID NO: 706 - RNA, 21 nt, synthetic construct
  source 1..21: mol_type = other RNA; note = Description of Artificial Sequence: Synthetic oligonucleotide
tgtccacagtcaacagctcgt

SEQ ID NO: 707 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gggccgagtacgaagtggact

SEQ ID NO: 708 - RNA, 21 nt, synthetic construct
  source 1..21: mol_type = other RNA; note = Description of Artificial Sequence: Synthetic oligonucleotide
ggccgagtacgaagtggacct

SEQ ID NO: 709 - RNA, 21 nt, synthetic construct
  source 1..21: mol_type = other RNA; note = Description of Artificial Sequence: Synthetic oligonucleotide
atcctggaagccagtgtgaat

SEQ ID NO: 710 - RNA, 21 nt, synthetic construct
  source 1..21: mol_type = other RNA; note = Description of Artificial Sequence: Synthetic oligonucleotide
tcctggaagccagtgtgaaat

SEQ ID NO: 711 - RNA, 21 nt, synthetic construct
  source 1..21: mol_type = other RNA; note = Description of Artificial Sequence: Synthetic oligonucleotide
cctggaagccagtgtgaaagt

SEQ ID NO: 712 - RNA, 21 nt, synthetic construct
  source 1..21: mol_type = other RNA; note = Description of Artificial Sequence: Synthetic oligonucleotide
ctggaagccagtgtgaaagat

SEQ ID NO: 713 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
tggaagccagtgtgaaagact

SEQ ID NO: 714 - RNA, 21 nt, synthetic construct
  source 1..21: mol_type = other RNA; note = Description of Artificial Sequence: Synthetic oligonucleotide
ggaagccagtgtgaaagacat

SEQ ID NO: 715 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
gaagccagtgtgaaagacatt

SEQ ID NO: 716 - RNA, 21 nt, synthetic construct
  source 1..21: mol_type = other RNA; note = Description of Artificial Sequence: Synthetic oligonucleotide
aagccagtgtgaaagacatat

SEQ ID NO: 717 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
agccagtgtgaaagacatagt

SEQ ID NO: 718 - RNA, 21 nt, synthetic construct
  source 1..21: mol_type = other RNA; note = Description of Artificial Sequence: Synthetic oligonucleotide
gccagtgtgaaagacatagct

SEQ ID NO: 719 - RNA, 21 nt, synthetic construct
  source 1..21: mol_type = other RNA; note = Description of Artificial Sequence: Synthetic oligonucleotide
agtgtgaaagacatagctgct

SEQ ID NO: 720 - RNA, 21 nt, synthetic construct
  source 1..21: mol_type = other RNA; note = Description of Artificial Sequence: Synthetic oligonucleotide
gtgtgaaagacatagctgcat

SEQ ID NO: 721 - RNA, 21 nt, synthetic construct
  source 1..21: mol_type = other RNA; note = Description of Artificial Sequence: Synthetic oligonucleotide
tgtgaaagacatagctgcatt

SEQ ID NO: 722 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gtgaaagacatagctgcattt

SEQ ID NO: 723 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
aattccacgctgggttgttat

SEQ ID NO: 724 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cacgctgggttgttaccgctt

SEQ ID NO: 725 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
acgctgggttgttaccgctat

SEQ ID NO: 726 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
cgctgggttgttaccgctact

SEQ ID NO: 727 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gctgggttgttaccgctacat

SEQ ID NO: 728 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctgggttgttaccgctacagt

SEQ ID NO: 729 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tgggttgttaccgctacagct

SEQ ID NO: 730 - RNA, 21 nt, synthetic construct
  source 1..21: mol_type = other RNA; note = Description of Artificial Sequence: Synthetic oligonucleotide
gggttgttaccgctacagctt

SEQ ID NO: 731 - RNA, 21 nt, synthetic construct
  source 1..21: mol_type = other RNA; note = Description of Artificial Sequence: Synthetic oligonucleotide
caaactccggctggagtggat

SEQ ID NO: 732 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cgactggccatgtatgacgtt

SEQ ID NO: 733 - RNA, 21 nt, synthetic construct
  source 1..21: mol_type = other RNA; note = Description of Artificial Sequence: Synthetic oligonucleotide
ctggagaagaggctcatcact

SEQ ID NO: 734 - RNA, 21 nt, synthetic construct
  source 1..21: mol_type = other RNA; note = Description of Artificial Sequence: Synthetic oligonucleotide
tggagaagaggctcatcacct

SEQ ID NO: 735 - RNA, 21 nt, synthetic construct
  source 1..21: mol_type = other RNA; note = Description of Artificial Sequence: Synthetic oligonucleotide
ggagaagaggctcatcacctt

SEQ ID NO: 736 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gagaagaggctcatcacctct

SEQ ID NO: 737 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gaagaggctcatcacctcggt

SEQ ID NO: 738 - RNA, 21 nt, synthetic construct
  source 1..21: mol_type = other RNA; note = Description of Artificial Sequence: Synthetic oligonucleotide
gaagaagggcctgcacagctt

SEQ ID NO: 739 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
aagaagggcctgcacagctat

SEQ ID NO: 740 - RNA, 21 nt, synthetic construct
  source 1..21: mol_type = other RNA; note = Description of Artificial Sequence: Synthetic oligonucleotide
aagggcctgcacagctactat

SEQ ID NO: 741 - RNA, 21 nt, synthetic construct
  source 1..21: mol_type = other RNA; note = Description of Artificial Sequence: Synthetic oligonucleotide
agggcctgcacagctactact

SEQ ID NO: 742 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cctgcacagctactacgacct

SEQ ID NO: 743 - RNA, 21 nt, synthetic construct
  source 1..21: mol_type = other RNA; note = Description of Artificial Sequence: Synthetic oligonucleotide
tggactacggcttggccctct

SEQ ID NO: 744 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ggactacggcttggccctctt

SEQ ID NO: 745 - RNA, 21 nt, synthetic construct
  source 1..21: mol_type = other RNA; note = Description of Artificial Sequence: Synthetic oligonucleotide
aggaggcagaagtatgatttt

SEQ ID NO: 746 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
agaagtatgatttgccgtgct

SEQ ID NO: 747 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gaagtatgatttgccgtgcat

SEQ ID NO: 748 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
aagtatgatttgccgtgcact

SEQ ID NO: 749 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
agtatgatttgccgtgcacct

SEQ ID NO: 750 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gtatgatttgccgtgcaccct

SEQ ID NO: 751 - RNA, 21 nt, synthetic construct
  source 1..21: mol_type = other RNA; note = Description of Artificial Sequence: Synthetic oligonucleotide
ggccagtggacgatccagaat

SEQ ID NO: 752 - RNA, 21 nt, synthetic construct
  source 1..21: mol_type = other RNA; note = Description of Artificial Sequence: Synthetic oligonucleotide
gccagtggacgatccagaact

SEQ ID NO: 753 - RNA, 21 nt, synthetic construct
  source 1..21: mol_type = other RNA; note = Description of Artificial Sequence: Synthetic oligonucleotide
ccagtggacgatccagaacat

SEQ ID NO: 754 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cagtggacgatccagaacagt

SEQ ID NO: 755 - RNA, 21 nt, synthetic construct
  source 1..21: mol_type = other RNA; note = Description of Artificial Sequence: Synthetic oligonucleotide
tggacgatccagaacaggagt

SEQ ID NO: 756 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
acttcacctcccagatctcct

SEQ ID NO: 757 - RNA, 21 nt, synthetic construct
  source 1..21: mol_type = other RNA; note = Description of Artificial Sequence: Synthetic oligonucleotide
cacctcccagatctccctcat

SEQ ID NO: 758 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tgtgcgggtgcactatggctt

SEQ ID NO: 759 - RNA, 21 nt, synthetic construct
  source 1..21: mol_type = other RNA; note = Description of Artificial Sequence: Synthetic oligonucleotide
tgcgggtgcactatggcttgt

SEQ ID NO: 760 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gcgggtgcactatggcttgtt

SEQ ID NO: 761 - RNA, 21 nt, synthetic construct
  source 1..21: mol_type = other RNA; note = Description of Artificial Sequence: Synthetic oligonucleotide
cgggtgcactatggcttgtat

SEQ ID NO: 762 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
gggtgcactatggcttgtact

SEQ ID NO: 763 - RNA, 21 nt, synthetic construct
  source 1..21: mol_type = other RNA; note = Description of Artificial Sequence: Synthetic oligonucleotide
ggtgcactatggcttgtacat

SEQ ID NO: 764 - RNA, 21 nt, synthetic construct
  source 1..21: mol_type = other RNA; note = Description of Artificial Sequence: Synthetic oligonucleotide
tgcactatggcttgtacaact

SEQ ID NO: 765 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
gcactatggcttgtacaacct

SEQ ID NO: 766 - RNA, 21 nt, synthetic construct
  source 1..21: mol_type = other RNA; note = Description of Artificial Sequence: Synthetic oligonucleotide
tgccctggagagttcctctgt

SEQ ID NO: 767 - RNA, 21 nt, synthetic construct
  source 1..21: mol_type = other RNA; note = Description of Artificial Sequence: Synthetic oligonucleotide
aacggcctggatgagagaaat

SEQ ID NO: 768 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
acggcctggatgagagaaact

SEQ ID NO: 769 - RNA, 21 nt, synthetic construct
  source 1..21: mol_type = other RNA; note = Description of Artificial Sequence: Synthetic oligonucleotide
cggcctggatgagagaaactt

SEQ ID NO: 770 - RNA, 21 nt, synthetic construct
  source 1..21: mol_type = other RNA; note = Description of Artificial Sequence: Synthetic oligonucleotide
cctggatgagagaaactgcgt

SEQ ID NO: 771 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
agagaaactgcgtttgcagat

SEQ ID NO: 772 - RNA, 21 nt, synthetic construct
  source 1..21: mol_type = other RNA; note = Description of Artificial Sequence: Synthetic oligonucleotide
gagaaactgcgtttgcagagt

SEQ ID NO: 773 - RNA, 21 nt, synthetic construct
  source 1..21: mol_type = other RNA; note = Description of Artificial Sequence: Synthetic oligonucleotide
ctgcgtttgcagagccacatt

SEQ ID NO: 774 - RNA, 21 nt, synthetic construct
  source 1..21: mol_type = other RNA; note = Description of Artificial Sequence: Synthetic oligonucleotide
tgcgtttgcagagccacattt

SEQ ID NO: 775 - RNA, 21 nt, synthetic construct
  source 1..21: mol_type = other RNA; note = Description of Artificial Sequence: Synthetic oligonucleotide
gcgtttgcagagccacattct

SEQ ID NO: 776 - RNA, 21 nt, synthetic construct
  source 1..21: mol_type = other RNA; note = Description of Artificial Sequence: Synthetic oligonucleotide
cgtttgcagagccacattcct

SEQ ID NO: 777 - RNA, 21 nt, synthetic construct
  source 1..21: mol_type = other RNA; note = Description of Artificial Sequence: Synthetic oligonucleotide
gcagagccacattccagtgct

SEQ ID NO: 778 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tgggacattcaccttccagtt

SEQ ID NO: 779 - RNA, 21 nt, synthetic construct
  source 1..21: mol_type = other RNA; note = Description of Artificial Sequence: Synthetic oligonucleotide
gggacattcaccttccagtgt

SEQ ID NO: 780 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
acattcaccttccagtgtgat

SEQ ID NO: 781 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gagctgcgtgaagaagcccat

SEQ ID NO: 782 - RNA, 21 nt, synthetic construct
  source 1..21: mol_type = other RNA; note = Description of Artificial Sequence: Synthetic oligonucleotide
agctgcgtgaagaagcccaat

SEQ ID NO: 783 - RNA, 21 nt, synthetic construct
  source 1..21: mol_type = other RNA; note = Description of Artificial Sequence: Synthetic oligonucleotide
gctgcgtgaagaagcccaact

SEQ ID NO: 784 - RNA, 21 nt, synthetic construct
  source 1..21: mol_type = other RNA; note = Description of Artificial Sequence: Synthetic oligonucleotide
ctgcgtgaagaagcccaacct

SEQ ID NO: 785 - RNA, 21 nt, synthetic construct
  source 1..21: mol_type = other RNA; note = Description of Artificial Sequence: Synthetic oligonucleotide
tgcgtgaagaagcccaaccct

SEQ ID NO: 786 - RNA, 21 nt, synthetic construct
  source 1..21: mol_type = other RNA; note = Description of Artificial Sequence: Synthetic oligonucleotide
agcactgtgactgtggcctct

SEQ ID NO: 787 - RNA, 21 nt, synthetic construct
  source 1..21: mol_type = other RNA; note = Description of Artificial Sequence: Synthetic oligonucleotide
ctccgagggtgagtggccatt

SEQ ID NO: 788 - RNA, 21 nt, synthetic construct
  source 1..21: mol_type = other RNA; note = Description of Artificial Sequence: Synthetic oligonucleotide
tcgctgaccgctgggtgatat

SEQ ID NO: 789 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cgctgaccgctgggtgataat

SEQ ID NO: 790 - RNA, 21 nt, synthetic construct
  source 1..21: mol_type = other RNA; note = Description of Artificial Sequence: Synthetic oligonucleotide
gctgaccgctgggtgataact

SEQ ID NO: 791 - RNA, 21 nt, synthetic construct
  source 1..21: mol_type = other RNA; note = Description of Artificial Sequence: Synthetic oligonucleotide
gctgggtgataacagctgcct

SEQ ID NO: 792 - RNA, 21 nt, synthetic construct
  source 1..21: mol_type = other RNA; note = Description of Artificial Sequence: Synthetic oligonucleotide
tgcttccaggaggacagcatt

SEQ ID NO: 793 - RNA, 21 nt, synthetic construct
  source 1..21: mol_type = other RNA; note = Description of Artificial Sequence: Synthetic oligonucleotide
gcttccaggaggacagcatgt

SEQ ID NO: 794 - RNA, 21 nt, synthetic construct
  source 1..21: mol_type = other RNA; note = Description of Artificial Sequence: Synthetic oligonucleotide
cttccaggaggacagcatggt

SEQ ID NO: 795 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
cgtgttcctgggcaaggtgtt

SEQ ID NO: 796 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ctgggcaaggtgtggcagaat

SEQ ID NO: 797 - RNA, 21 nt, synthetic construct
  source 1..21: mol_type = other RNA; note = Description of Artificial Sequence: Synthetic oligonucleotide
tgggcaaggtgtggcagaact

SEQ ID NO: 798 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
  modified_base 11: mod_base = OTHER; note = Thymine
gggcaaggtgtggcagaactt

SEQ ID NO: 799 - RNA, 21 nt, synthetic construct
  source 1..21: mol_type = other RNA; note = Description of Artificial Sequence: Synthetic oligonucleotide
ggcaaggtgtggcagaactct

SEQ ID NO: 800 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gcaaggtgtggcagaactcgt

SEQ ID NO: 801 - RNA, 21 nt, synthetic construct
  source 1..21: mol_type = other RNA; note = Description of Artificial Sequence: Synthetic oligonucleotide
caaggtgtggcagaactcgct

SEQ ID NO: 802 - RNA, 21 nt, synthetic construct
  source 1..21: mol_type = other RNA; note = Description of Artificial Sequence: Synthetic oligonucleotide
tggcctggagaggtgtccttt

SEQ ID NO: 803 - RNA, 21 nt, synthetic construct
  source 1..21: mol_type = other RNA; note = Description of Artificial Sequence: Synthetic oligonucleotide
ggcctggagaggtgtccttct

SEQ ID NO: 804 - RNA, 21 nt, synthetic construct
  source 1..21: mol_type = other RNA; note = Description of Artificial Sequence: Synthetic oligonucleotide
gcctggagaggtgtccttcat

SEQ ID NO: 805 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cctggagaggtgtccttcaat

SEQ ID NO: 806 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
agaggtgtccttcaaggtgat

SEQ ID NO: 807 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tgtgcagttgatcccacaggt

SEQ ID NO: 808 - RNA, 21 nt, synthetic construct
  source 1..21: mol_type = other RNA; note = Description of Artificial Sequence: Synthetic oligonucleotide
tgcagttgatcccacaggact

SEQ ID NO: 809 - RNA, 21 nt, synthetic construct
  source 1..21: mol_type = other RNA; note = Description of Artificial Sequence: Synthetic oligonucleotide
cccacaggacctgtgcagcgt

SEQ ID NO: 810 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ccacaggacctgtgcagcgat

SEQ ID NO: 811 - RNA, 21 nt, synthetic construct
  source 1..21: mol_type = other RNA; note = Description of Artificial Sequence: Synthetic oligonucleotide
ccaggtgacgccacgcatgct

SEQ ID NO: 812 - RNA, 21 nt, synthetic construct
  source 1..21: mol_type = other RNA; note = Description of Artificial Sequence: Synthetic oligonucleotide
gtgacgccacgcatgctgtgt

SEQ ID NO: 813 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
acgccacgcatgctgtgtgct

SEQ ID NO: 814 - RNA, 21 nt, synthetic construct
  source 1..21: mol_type = other RNA; note = Description of Artificial Sequence: Synthetic oligonucleotide
ggctaccgcaagggcaagaat

SEQ ID NO: 815 - RNA, 21 nt, synthetic construct
  source 1..21: mol_type = other RNA; note = Description of Artificial Sequence: Synthetic oligonucleotide
gtgcaaggcactcagtggcct

SEQ ID NO: 816 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctaactacttcggcgtctact

SEQ ID NO: 817 - RNA, 21 nt, synthetic construct
  source 1..21: mol_type = other RNA; note = Description of Artificial Sequence: Synthetic oligonucleotide
actacttcggcgtctacacct

SEQ ID NO: 818 - RNA, 21 nt, synthetic construct
  source 1..21: mol_type = other RNA; note = Description of Artificial Sequence: Synthetic oligonucleotide
ctacttcggcgtctacaccct

SEQ ID NO: 819 - RNA, 21 nt, synthetic construct
  source 1..21: mol_type = other RNA; note = Description of Artificial Sequence: Synthetic oligonucleotide
gcgtctacacccgcatcacat

SEQ ID NO: 820 - RNA, 21 nt, synthetic construct
  source 1..21: mol_type = other RNA; note = Description of Artificial Sequence: Synthetic oligonucleotide
cgtctacacccgcatcacagt

SEQ ID NO: 821 - RNA, 21 nt, synthetic construct
  source 1..21: mol_type = other RNA; note = Description of Artificial Sequence: Synthetic oligonucleotide
acccgcatcacaggtgtgatt

SEQ ID NO: 822 - RNA, 21 nt, synthetic construct
  source 1..21: mol_type = other RNA; note = Description of Artificial Sequence: Synthetic oligonucleotide
cccgcatcacaggtgtgatct

SEQ ID NO: 823 - RNA, 21 nt, synthetic construct
  source 1..21: mol_type = other RNA; note = Description of Artificial Sequence: Synthetic oligonucleotide
tggatccagcaagtggtgact

SEQ ID NO: 824 - RNA, 21 nt, synthetic construct
  source 1..21: mol_type = other RNA; note = Description of Artificial Sequence: Synthetic oligonucleotide
gatccagcaagtggtgacctt

SEQ ID NO: 825 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
atccagcaagtggtgacctgt

SEQ ID NO: 826 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ccagcaagtggtgacctgagt

SEQ ID NO: 827 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cagcaagtggtgacctgaggt

SEQ ID NO: 828 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
gcaagtggtgacctgaggaat

SEQ ID NO: 829 - RNA, 21 nt, synthetic construct
  source 1..21: mol_type = other RNA; note = Description of Artificial Sequence: Synthetic oligonucleotide
tggtggcaggaggtggcatct

SEQ ID NO: 830 - RNA, 21 nt, synthetic construct
  source 1..21: mol_type = other RNA; note = Description of Artificial Sequence: Synthetic oligonucleotide
ggtggcaggaggtggcatctt

SEQ ID NO: 831 - RNA, 21 nt, synthetic construct
  source 1..21: mol_type = other RNA; note = Description of Artificial Sequence: Synthetic oligonucleotide
gtggcaggaggtggcatcttt

SEQ ID NO: 832 - RNA, 21 nt, synthetic construct
  source 1..21: mol_type = other RNA; note = Description of Artificial Sequence: Synthetic oligonucleotide
tccctgatgtctgctccagtt

SEQ ID NO: 833 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctgatgtctgctccagtgatt

SEQ ID NO: 834 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
tccagtgatggcaggaggatt

SEQ ID NO: 835 - RNA, 21 nt, synthetic construct
  source 1..21: mol_type = other RNA; note = Description of Artificial Sequence: Synthetic oligonucleotide
ctaacttgggatctgggaatt

SEQ ID NO: 836 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ttgggatctgggaatggaagt

SEQ ID NO: 837 - RNA, 21 nt, synthetic construct
  source 1..21: mol_type = other RNA; note = Description of Artificial Sequence: Synthetic oligonucleotide
gtgagctcagctgccctttgt

SEQ ID NO: 838 - RNA, 21 nt, synthetic construct
  source 1..21: mol_type = other RNA; note = Description of Artificial Sequence: Synthetic oligonucleotide
ctcagctgccctttggaatat

SEQ ID NO: 839 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
tcagctgccctttggaataat

SEQ ID NO: 840 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
cagctgccctttggaataaat

SEQ ID NO: 841 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 9: mod_base = OTHER; note = Thymine
ctgccctttggaataaagctt

SEQ ID NO: 842 - RNA, 21 nt, synthetic construct
  source 1..21: mol_type = other RNA; note = Description of Artificial Sequence: Synthetic oligonucleotide
gccctttggaataaagctgct

SEQ ID NO: 843 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 11: mod_base = OTHER; note = Thymine
ccctttggaataaagctgcct

SEQ ID NO: 844 - RNA, 21 nt, synthetic construct
  source 1..21: mol_type = other RNA; note = Description of Artificial Sequence: Synthetic oligonucleotide
cctttggaataaagctgcctt

SEQ ID NO: 845 - RNA, 21 nt, synthetic construct
  source 1..21: mol_type = other RNA; note = Description of Artificial Sequence: Synthetic oligonucleotide
tttggaataaagctgcctgat

SEQ ID NO: 846 - RNA, 21 nt, synthetic construct
  source 1..21: mol_type = other RNA; note = Description of Artificial Sequence: Synthetic oligonucleotide
ttggaataaagctgcctgatt

SEQ ID NO: 847 - RNA, 21 nt, synthetic construct
  source 1..21: mol_type = other RNA; note = Description of Artificial Sequence: Synthetic oligonucleotide
tggaataaagctgcctgatct

SEQ ID NO: 848 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acttcctcgccatcacctccgtc

SEQ ID NO: 849 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agcttcctcgccatcacctccgt

SEQ ID NO: 850 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attggagtcctcacaggccttga

SEQ ID NO: 851 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atcttggagtcctcacaggcctt

SEQ ID NO: 852 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
actcttggagtcctcacaggcct

SEQ ID NO: 853 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 12: mod_base = OTHER; note = Thymine
atctcttggagtcctcacaggcc

SEQ ID NO: 854 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
attctcttggagtcctcacaggc

SEQ ID NO: 855 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 14: mod_base = OTHER; note = Thymine
ataccctaggaaataccagagta

SEQ ID NO: 856 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgtaccctaggaaataccagag

SEQ ID NO: 857 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attgtaccctaggaaataccaga

SEQ ID NO: 858 - RNA, 23 nt, synthetic construct
  source 1..23: mol_type = other RNA; note = Description of Artificial Sequence: Synthetic oligonucleotide
acttgtaccctaggaaataccag

SEQ ID NO: 859 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
accttgtaccctaggaaatacca

SEQ ID NO: 860 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
aacctccgccttgtaccctagga

SEQ ID NO: 861 - RNA, 23 nt, synthetic construct
  source 1..23: mol_type = other RNA; note = Description of Artificial Sequence: Synthetic oligonucleotide
agagtacacctggctgaccatca

SEQ ID NO: 862 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
acctgagtacacctggctgacca

SEQ ID NO: 863 - RNA, 23 nt, synthetic construct
  source 1..23: mol_type = other RNA; note = Description of Artificial Sequence: Synthetic oligonucleotide
agcctgagtacacctggctgacc

SEQ ID NO: 864 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgcctgagtacacctggctgac

SEQ ID NO: 865 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgggagaagtggcgattgagta

SEQ ID NO: 866 - RNA, 23 nt, synthetic construct
  source 1..23: mol_type = other RNA; note = Description of Artificial Sequence: Synthetic oligonucleotide
aagatcctgggagaagtggcgat

SEQ ID NO: 867 - RNA, 23 nt, synthetic construct
  source 1..23: mol_type = other RNA; note = Description of Artificial Sequence: Synthetic oligonucleotide
agtaagatcctgggagaagtggc

SEQ ID NO: 868 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
agcgggtaagatcctgggagaag

SEQ ID NO: 869 - RNA, 23 nt, synthetic construct
  source 1..23: mol_type = other RNA; note = Description of Artificial Sequence: Synthetic oligonucleotide
aggcgggtaagatcctgggagaa

SEQ ID NO: 870 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
acggcgggtaagatcctgggaga

SEQ ID NO: 871 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atttcactgcggaaggcactaga

SEQ ID NO: 872 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggcggtttcactgcggaaggca

SEQ ID NO: 873 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
atggcggtttcactgcggaaggc

SEQ ID NO: 874 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
actttggcggtttcactgcggaa

SEQ ID NO: 875 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
agctttggcggtttcactgcgga

SEQ ID NO: 876 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
aggctttggcggtttcactgcgg

SEQ ID NO: 877 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
agggctttggcggtttcactgcg

SEQ ID NO: 878 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atgggctttggcggtttcactgc

SEQ ID NO: 879 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcatcttctgggctttggcggt

SEQ ID NO: 880 - RNA, 23 nt, synthetic construct
  source 1..23: mol_type = other RNA; note = Description of Artificial Sequence: Synthetic oligonucleotide
aagcatcttctgggctttggcgg

SEQ ID NO: 881 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
accttgagcatcttctgggcttt

SEQ ID NO: 882 - RNA, 23 nt, synthetic construct
  source 1..23: mol_type = other RNA; note = Description of Artificial Sequence: Synthetic oligonucleotide
aaagttcccaggcgggtgctggt

SEQ ID NO: 883 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
ataagttcccaggcgggtgctgg

SEQ ID NO: 884 - RNA, 23 nt, synthetic construct
  source 1..23: mol_type = other RNA; note = Description of Artificial Sequence: Synthetic oligonucleotide
aatagacggagctggagttgtag

SEQ ID NO: 885 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaatagacggagctggagttgta

SEQ ID NO: 886 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgaaccagaagaagcaggtgag

SEQ ID NO: 887 - RNA, 23 nt, synthetic construct
  source 1..23: mol_type = other RNA; note = Description of Artificial Sequence: Synthetic oligonucleotide
agaatgaaccagaagaagcaggt

SEQ ID NO: 888 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attggagaatgaaccagaagaag

SEQ ID NO: 889 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atttggagaatgaaccagaagaa

SEQ ID NO: 890 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aatttggagaatgaaccagaaga

SEQ ID NO: 891 - RNA, 23 nt, synthetic construct
  source 1..23: mol_type = other RNA; note = Description of Artificial Sequence: Synthetic oligonucleotide
agatttggagaatgaaccagaag

SEQ ID NO: 892 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
aggatttggagaatgaaccagaa

SEQ ID NO: 893 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agtggacagcagctcctccacca

SEQ ID NO: 894 - RNA, 23 nt, synthetic construct
  source 1..23: mol_type = other RNA; note = Description of Artificial Sequence: Synthetic oligonucleotide
aactgtggacagcagctcctcca

SEQ ID NO: 895 - RNA, 23 nt, synthetic construct
  source 1..23: mol_type = other RNA; note = Description of Artificial Sequence: Synthetic oligonucleotide
agttgactgtggacagcagctcc

SEQ ID NO: 896 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgttgactgtggacagcagctc

SEQ ID NO: 897 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
  modified_base 14: mod_base = OTHER; note = Thymine
aagctgttgactgtggacagcag

SEQ ID NO: 898 - RNA, 23 nt, synthetic construct
  source 1..23: mol_type = other RNA; note = Description of Artificial Sequence: Synthetic oligonucleotide
agagctgttgactgtggacagca

SEQ ID NO: 899 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
acgagctgttgactgtggacagc

SEQ ID NO: 900 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acacttcgtactcggccctgtag

SEQ ID NO: 901 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agtccacttcgtactcggccctg

SEQ ID NO: 902 - RNA, 23 nt, synthetic construct
  source 1..23: mol_type = other RNA; note = Description of Artificial Sequence: Synthetic oligonucleotide
aggtccacttcgtactcggccct

SEQ ID NO: 903 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
attcacactggcttccaggatca

SEQ ID NO: 904 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
atttcacactggcttccaggatc

SEQ ID NO: 905 - RNA, 23 nt, synthetic construct
  source 1..23: mol_type = other RNA; note = Description of Artificial Sequence: Synthetic oligonucleotide
actttcacactggcttccaggat

SEQ ID NO: 906 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
atctttcacactggcttccagga

SEQ ID NO: 907 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agtctttcacactggcttccagg

SEQ ID NO: 908 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 14: mod_base = OTHER; note = Thymine
atgtctttcacactggcttccag

SEQ ID NO: 909 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aatgtctttcacactggcttcca

SEQ ID NO: 910 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atatgtctttcacactggcttcc

SEQ ID NO: 911 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
actatgtctttcacactggcttc

SEQ ID NO: 912 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agctatgtctttcacactggctt

SEQ ID NO: 913 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
aagctatgtctttcacactggct

SEQ ID NO: 914 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
agcagctatgtctttcacactgg

SEQ ID NO: 915 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
  modified_base 14: mod_base = OTHER; note = Thymine
atgcagctatgtctttcacactg

SEQ ID NO: 916 - RNA, 23 nt, synthetic construct
  source 1..23: mol_type = other RNA; note = Description of Artificial Sequence: Synthetic oligonucleotide
aatgcagctatgtctttcacact

SEQ ID NO: 917 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
aaatgcagctatgtctttcacac

SEQ ID NO: 918 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atagcggtaacaacccagcgtgg

SEQ ID NO: 919 - RNA, 23 nt, synthetic construct
  source 1..23: mol_type = other RNA; note = Description of Artificial Sequence: Synthetic oligonucleotide
agtagcggtaacaacccagcgtg

SEQ ID NO: 920 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgtagcggtaacaacccagcgt

SEQ ID NO: 921 - RNA, 23 nt, synthetic construct
  source 1..23: mol_type = other RNA; note = Description of Artificial Sequence: Synthetic oligonucleotide
actgtagcggtaacaacccagcg

SEQ ID NO: 922 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agctgtagcggtaacaacccagc

SEQ ID NO: 923 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagctgtagcggtaacaacccag

SEQ ID NO: 924 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atccactccagccggagtttgag

SEQ ID NO: 925 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
aatacatggccagtcggtcccgg

SEQ ID NO: 926 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aacgtcatacatggccagtcggt

SEQ ID NO: 927 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
agtgatgagcctcttctccaggg

SEQ ID NO: 928 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggtgatgagcctcttctccagg

SEQ ID NO: 929 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaggtgatgagcctcttctccag

SEQ ID NO: 930 - RNA, 23 nt, synthetic construct
  source 1..23: mol_type = other RNA; note = Description of Artificial Sequence: Synthetic oligonucleotide
agaggtgatgagcctcttctcca

SEQ ID NO: 931 - RNA, 23 nt, synthetic construct
  source 1..23: mol_type = other RNA; note = Description of Artificial Sequence: Synthetic oligonucleotide
accgaggtgatgagcctcttctc

SEQ ID NO: 932 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagctgtgcaggcccttcttcca

SEQ ID NO: 933 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atagctgtgcaggcccttcttcc

SEQ ID NO: 934 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atagtagctgtgcaggcccttct

SEQ ID NO: 935 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agtagtagctgtgcaggcccttc

SEQ ID NO: 936 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
aggtcgtagtagctgtgcaggcc

SEQ ID NO: 937 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agccaagccgtagtccagagagg

SEQ ID NO: 938 - RNA, 23 nt, synthetic construct
  source 1..23: mol_type = other RNA; note = Description of Artificial Sequence: Synthetic oligonucleotide
agagggccaagccgtagtccaga

SEQ ID NO: 939 - RNA, 23 nt, synthetic construct
  source 1..23: mol_type = other RNA; note = Description of Artificial Sequence: Synthetic oligonucleotide
aagagggccaagccgtagtccag

SEQ ID NO: 940 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
aaaatcatacttctgcctcctca

SEQ ID NO: 941 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agtgcacggcaaatcatacttct

SEQ ID NO: 942 - RNA, 23 nt, synthetic construct
  source 1..23: mol_type = other RNA; note = Description of Artificial Sequence: Synthetic oligonucleotide
aggtgcacggcaaatcatacttc

SEQ ID NO: 943 - RNA, 23 nt, synthetic construct
  source 1..23: mol_type = other RNA; note = Description of Artificial Sequence: Synthetic oligonucleotide
agggtgcacggcaaatcatactt

SEQ ID NO: 944 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
attctggatcgtccactggccct

SEQ ID NO: 945 - RNA, 23 nt, synthetic construct
  source 1..23: mol_type = other RNA; note = Description of Artificial Sequence: Synthetic oligonucleotide
agttctggatcgtccactggccc

SEQ ID NO: 946 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 14: mod_base = OTHER; note = Thymine
atgttctggatcgtccactggcc

SEQ ID NO: 947 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
actgttctggatcgtccactggc

SEQ ID NO: 948 - RNA, 23 nt, synthetic construct
  source 1..23: mol_type = other RNA; note = Description of Artificial Sequence: Synthetic oligonucleotide
actcctgttctggatcgtccact

SEQ ID NO: 949 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
acacacagcctcctgttctggat

SEQ ID NO: 950 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggagatctgggaggtgaagttg

SEQ ID NO: 951 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgagggagatctgggaggtgaa

SEQ ID NO: 952 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acaagccatagtgcacccgcaca

SEQ ID NO: 953 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
atacaagccatagtgcacccgca

SEQ ID NO: 954 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgtacaagccatagtgcacccg

SEQ ID NO: 955 - RNA, 23 nt, synthetic construct
  source 1..23: mol_type = other RNA; note = Description of Artificial Sequence: Synthetic oligonucleotide
agttgtacaagccatagtgcacc

SEQ ID NO: 956 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aggttgtacaagccatagtgcac

SEQ ID NO: 957 - RNA, 23 nt, synthetic construct
  source 1..23: mol_type = other RNA; note = Description of Artificial Sequence: Synthetic oligonucleotide
acagaggaactctccagggcagg

SEQ ID NO: 958 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atttctctcatccaggccgttgg

SEQ ID NO: 959 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
agtttctctcatccaggccgttg

SEQ ID NO: 960 - RNA, 23 nt, synthetic construct
  source 1..23: mol_type = other RNA; note = Description of Artificial Sequence: Synthetic oligonucleotide
aagtttctctcatccaggccgtt

SEQ ID NO: 961 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acgcagtttctctcatccaggcc

SEQ ID NO: 962 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atctgcaaacgcagtttctctca

SEQ ID NO: 963 - RNA, 23 nt, synthetic construct
  source 1..23: mol_type = other RNA; note = Description of Artificial Sequence: Synthetic oligonucleotide
actctgcaaacgcagtttctctc

SEQ ID NO: 964 - RNA, 23 nt, synthetic construct
  source 1..23: mol_type = other RNA; note = Description of Artificial Sequence: Synthetic oligonucleotide
aatgtggctctgcaaacgcagtt

SEQ ID NO: 965 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aaatgtggctctgcaaacgcagt

SEQ ID NO: 966 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agaatgtggctctgcaaacgcag

SEQ ID NO: 967 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
aggaatgtggctctgcaaacgca

SEQ ID NO: 968 - RNA, 23 nt, synthetic construct
  source 1..23: mol_type = other RNA; note = Description of Artificial Sequence: Synthetic oligonucleotide
agcactggaatgtggctctgcaa

SEQ ID NO: 969 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
acactggaaggtgaatgtcccac

SEQ ID NO: 970 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atgggcttcttcacgcagctccg

SEQ ID NO: 971 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
attgggcttcttcacgcagctcc

SEQ ID NO: 972 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agttgggcttcttcacgcagctc

SEQ ID NO: 973 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aggttgggcttcttcacgcagct

SEQ ID NO: 974 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
agggttgggcttcttcacgcagc

SEQ ID NO: 975 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agaggccacagtcacagtgctcc

SEQ ID NO: 976 - RNA, 23 nt, synthetic construct
  source 1..23: mol_type = other RNA; note = Description of Artificial Sequence: Synthetic oligonucleotide
aatggccactcaccctcggagga

SEQ ID NO: 977 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aatcacccagcggtcagcgatga

SEQ ID NO: 978 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atatcacccagcggtcagcgatg

SEQ ID NO: 979 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attatcacccagcggtcagcgat

SEQ ID NO: 980 - RNA, 23 nt, synthetic construct
  source 1..23: mol_type = other RNA; note = Description of Artificial Sequence: Synthetic oligonucleotide
agttatcacccagcggtcagcga

SEQ ID NO: 981 - RNA, 23 nt, synthetic construct
  source 1..23: mol_type = other RNA; note = Description of Artificial Sequence: Synthetic oligonucleotide
aggcagctgttatcacccagcgg

SEQ ID NO: 982 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aatgctgtcctcctggaagcagt

SEQ ID NO: 983 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
acatgctgtcctcctggaagcag

SEQ ID NO: 984 - RNA, 23 nt, synthetic construct
  source 1..23: mol_type = other RNA; note = Description of Artificial Sequence: Synthetic oligonucleotide
accatgctgtcctcctggaagca

SEQ ID NO: 985 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
attctgccacaccttgcccagga

SEQ ID NO: 986 - RNA, 23 nt, synthetic construct
  source 1..23: mol_type = other RNA; note = Description of Artificial Sequence: Synthetic oligonucleotide
agttctgccacaccttgcccagg

SEQ ID NO: 987 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagttctgccacaccttgcccag

SEQ ID NO: 988 - RNA, 23 nt, synthetic construct
  source 1..23: mol_type = other RNA; note = Description of Artificial Sequence: Synthetic oligonucleotide
agagttctgccacaccttgccca

SEQ ID NO: 989 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcgagttctgccacaccttgcc

SEQ ID NO: 990 - RNA, 23 nt, synthetic construct
  source 1..23: mol_type = other RNA; note = Description of Artificial Sequence: Synthetic oligonucleotide
aaaggacacctctccaggccagc

SEQ ID NO: 991 - RNA, 23 nt, synthetic construct
  source 1..23: mol_type = other RNA; note = Description of Artificial Sequence: Synthetic oligonucleotide
  modified_base 12: mod_base = OTHER; note = Thymine
  modified_base 14: mod_base = OTHER; note = Thymine
agaaggacacctctccaggccag

SEQ ID NO: 992 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atgaaggacacctctccaggcca

SEQ ID NO: 993 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
attgaaggacacctctccaggcc

SEQ ID NO: 994 - RNA, 23 nt, synthetic construct
  source 1..23: mol_type = other RNA; note = Description of Artificial Sequence: Synthetic oligonucleotide
acctgtgggatcaactgcacatc

SEQ ID NO: 995 - RNA, 23 nt, synthetic construct
  source 1..23: mol_type = other RNA; note = Description of Artificial Sequence: Synthetic oligonucleotide
agtcctgtgggatcaactgcaca

SEQ ID NO: 996 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
actgcacaggtcctgtgggatca

SEQ ID NO: 997 - RNA, 23 nt, synthetic construct
  source 1..23: mol_type = other RNA; note = Description of Artificial Sequence: Synthetic oligonucleotide
acgctgcacaggtcctgtgggat

SEQ ID NO: 998 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
atcgctgcacaggtcctgtggga

SEQ ID NO: 999 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agcatgcgtggcgtcacctggta

SEQ ID NO: 1000 - RNA, 23 nt, synthetic construct
  source 1..23: mol_type = other RNA; note = Description of Artificial Sequence: Synthetic oligonucleotide
acacagcatgcgtggcgtcacct

SEQ ID NO: 1001 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aacacagcatgcgtggcgtcacc

SEQ ID NO: 1002 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agcacacagcatgcgtggcgtca

SEQ ID NO: 1003 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
attcttgcccttgcggtagccgg

SEQ ID NO: 1004 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
accttcttgcccttgcggtagcc

SEQ ID NO: 1005 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aggccactgagtgccttgcacac

SEQ ID NO: 1006 - RNA, 23 nt, synthetic construct
  source 1..23: mol_type = other RNA; note = Description of Artificial Sequence: Synthetic oligonucleotide
agtagacgccgaagtagttaggc

SEQ ID NO: 1007 - RNA, 23 nt, synthetic construct
  source 1..23: mol_type = other RNA; note = Description of Artificial Sequence: Synthetic oligonucleotide
aggtgtagacgccgaagtagtta

SEQ ID NO: 1008 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agggtgtagacgccgaagtagtt

SEQ ID NO: 1009 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atgtgatgcgggtgtagacgccg

SEQ ID NO: 1010 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
actgtgatgcgggtgtagacgcc

SEQ ID NO: 1011 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aatcacacctgtgatgcgggtgt

SEQ ID NO: 1012 - RNA, 23 nt, synthetic construct
  source 1..23: mol_type = other RNA; note = Description of Artificial Sequence: Synthetic oligonucleotide
agatcacacctgtgatgcgggtg

SEQ ID NO: 1013 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agtcaccacttgctggatccagc

SEQ ID NO: 1014 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aaggtcaccacttgctggatcca

SEQ ID NO: 1015 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
acaggtcaccacttgctggatcc

SEQ ID NO: 1016 - RNA, 23 nt, synthetic construct
  source 1..23: mol_type = other RNA; note = Description of Artificial Sequence: Synthetic oligonucleotide
actcaggtcaccacttgctggat

SEQ ID NO: 1017 - RNA, 23 nt, synthetic construct
  source 1..23: mol_type = other RNA; note = Description of Artificial Sequence: Synthetic oligonucleotide
acctcaggtcaccacttgctgga

SEQ ID NO: 1018 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attcctcaggtcaccacttgctg

SEQ ID NO: 1019 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agatgccacctcctgccaccaca

SEQ ID NO: 1020 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aagatgccacctcctgccaccac

SEQ ID NO: 1021 - RNA, 23 nt, synthetic construct
  source 1..23: mol_type = other RNA; note = Description of Artificial Sequence: Synthetic oligonucleotide
aaagatgccacctcctgccacca

SEQ ID NO: 1022 - RNA, 23 nt, synthetic construct
  source 1..23: mol_type = other RNA; note = Description of Artificial Sequence: Synthetic oligonucleotide
aactggagcagacatcagggacg

SEQ ID NO: 1023 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aatcactggagcagacatcaggg

SEQ ID NO: 1024 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aatcctcctgccatcactggagc

SEQ ID NO: 1025 - RNA, 23 nt, synthetic construct
  source 1..23: mol_type = other RNA; note = Description of Artificial Sequence: Synthetic oligonucleotide
aattcccagatcccaagttagac

SEQ ID NO: 1026 - RNA, 23 nt, synthetic construct
  source 1..23: mol_type = other RNA; note = Description of Artificial Sequence: Synthetic oligonucleotide
acaaagggcagctgagctcacct

SEQ ID NO: 1027 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atattccaaagggcagctgagct

SEQ ID NO: 1028 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
attattccaaagggcagctgagc

SEQ ID NO: 1029 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
atttattccaaagggcagctgag

SEQ ID NO: 1030 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aagctttattccaaagggcagct

SEQ ID NO: 1031 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
agcagctttattccaaagggcag

SEQ ID NO: 1032 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
aggcagctttattccaaagggca

SEQ ID NO: 1033 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaggcagctttattccaaagggc

SEQ ID NO: 1034 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
atcaggcagctttattccaaagg

SEQ ID NO: 1035 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
aatcaggcagctttattccaaag

SEQ ID NO: 1036 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
agatcaggcagctttattccaaa

SEQ ID NO: 1037 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cggaggtgatggcgaggaagt

SEQ ID NO: 1038 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggaggtgatggcgaggaagct

SEQ ID NO: 1039 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aaggcctgtgaggactccaat

SEQ ID NO: 1040 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggcctgtgaggactccaagat

SEQ ID NO: 1041 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcctgtgaggactccaagagt

SEQ ID NO: 1042 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctgtgaggactccaagagat

SEQ ID NO: 1043 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgtgaggactccaagagaat

SEQ ID NO: 1044 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctactctggtatttcctaggt

SEQ ID NO: 1045 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctctggtatttcctagggtat

SEQ ID NO: 1046 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tctggtatttcctagggtact

SEQ ID NO: 1047 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctggtatttcctagggtacat

SEQ ID NO: 1048 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggtatttcctagggtacaat

SEQ ID NO: 1049 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggtatttcctagggtacaagt

SEQ ID NO: 1050 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtatttcctagggtacaaggt

SEQ ID NO: 1051 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctagggtacaaggcggaggtt

SEQ ID NO: 1052 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
atggtcagccaggtgtactct

SEQ ID NO: 1053 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggtcagccaggtgtactcagt

SEQ ID NO: 1054 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtcagccaggtgtactcaggt

SEQ ID NO: 1055 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcagccaggtgtactcaggct

SEQ ID NO: 1056 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagccaggtgtactcaggcat

SEQ ID NO: 1057 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agccaggtgtactcaggcagt

SEQ ID NO: 1058 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctcaatcgccacttctcccat

SEQ ID NO: 1059 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgccacttctcccaggatctt

SEQ ID NO: 1060 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccacttctcccaggatcttt

SEQ ID NO: 1061 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cacttctcccaggatcttact

SEQ ID NO: 1062 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tctcccaggatcttacccgct

SEQ ID NO: 1063 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctcccaggatcttacccgcct

SEQ ID NO: 1064 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcccaggatcttacccgccgt

SEQ ID NO: 1065 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tagtgccttccgcagtgaaat

SEQ ID NO: 1066 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccttccgcagtgaaaccgct

SEQ ID NO: 1067 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccttccgcagtgaaaccgcct

SEQ ID NO: 1068 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cttccgcagtgaaaccgccat

SEQ ID NO: 1069 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccgcagtgaaaccgccaaagt

SEQ ID NO: 1070 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgcagtgaaaccgccaaagct

SEQ ID NO: 1071 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcagtgaaaccgccaaagcct

SEQ ID NO: 1072 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagtgaaaccgccaaagccct

SEQ ID NO: 1073 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agtgaaaccgccaaagcccat

SEQ ID NO: 1074 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgccaaagcccagaagatgct

SEQ ID NO: 1075 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccaaagcccagaagatgctt

SEQ ID NO: 1076 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agcccagaagatgctcaaggt

SEQ ID NO: 1077 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagcacccgcctgggaacttt

SEQ ID NO: 1078 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agcacccgcctgggaacttat

SEQ ID NO: 1079 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acaactccagctccgtctatt

SEQ ID NO: 1080 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
caactccagctccgtctattt

SEQ ID NO: 1081 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcacctgcttcttctggttct

SEQ ID NO: 1082 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cacctgcttcttctggttcat

SEQ ID NO: 1083 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctgcttcttctggttcattt

SEQ ID NO: 1084 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgcttcttctggttcattct

SEQ ID NO: 1085 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcttcttctggttcattctt

SEQ ID NO: 1086 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cttcttctggttcattctcct

SEQ ID NO: 1087 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ttcttctggttcattctccat

SEQ ID NO: 1088 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcttctggttcattctccaat

SEQ ID NO: 1089 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cttctggttcattctccaaat

SEQ ID NO: 1090 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ttctggttcattctccaaatt

SEQ ID NO: 1091 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tctggttcattctccaaatct

SEQ ID NO: 1092 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctggttcattctccaaatcct

SEQ ID NO: 1093 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtggaggagctgctgtccact

SEQ ID NO: 1094 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaggagctgctgtccacagtt

SEQ ID NO: 1095 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agctgctgtccacagtcaact

SEQ ID NO: 1096 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgctgtccacagtcaacat

SEQ ID NO: 1097 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgtccacagtcaacagctt

SEQ ID NO: 1098 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgtccacagtcaacagctct

SEQ ID NO: 1099 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgtccacagtcaacagctcgt

SEQ ID NO: 1100 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acagggccgagtacgaagtgt

SEQ ID NO: 1101 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggccgagtacgaagtggact

SEQ ID NO: 1102 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggccgagtacgaagtggacct

SEQ ID NO: 1103 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
atcctggaagccagtgtgaat

SEQ ID NO: 1104 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcctggaagccagtgtgaaat

SEQ ID NO: 1105 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctggaagccagtgtgaaagt

SEQ ID NO: 1106 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctggaagccagtgtgaaagat

SEQ ID NO: 1107 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggaagccagtgtgaaagact

SEQ ID NO: 1108 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggaagccagtgtgaaagacat

SEQ ID NO: 1109 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaagccagtgtgaaagacatt

SEQ ID NO: 1110 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aagccagtgtgaaagacatat

SEQ ID NO: 1111 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agccagtgtgaaagacatagt

SEQ ID NO: 1112 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccagtgtgaaagacatagct

SEQ ID NO: 1113 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccagtgtgaaagacatagctt

SEQ ID NO: 1114 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agtgtgaaagacatagctgct

SEQ ID NO: 1115 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgtgaaagacatagctgcat

SEQ ID NO: 1116 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgtgaaagacatagctgcatt

SEQ ID NO: 1117 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgaaagacatagctgcattt

SEQ ID NO: 1118 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
attgaattccacgctgggttt

SEQ ID NO: 1119 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aattccacgctgggttgttat

SEQ ID NO: 1120 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cacgctgggttgttaccgctt

SEQ ID NO: 1121 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acgctgggttgttaccgctat

SEQ ID NO: 1122 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgctgggttgttaccgctact

SEQ ID NO: 1123 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgggttgttaccgctacat

SEQ ID NO: 1124 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgggttgttaccgctacagt

SEQ ID NO: 1125 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgggttgttaccgctacagct

SEQ ID NO: 1126 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggttgttaccgctacagctt

SEQ ID NO: 1127 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
caaactccggctggagtggat

SEQ ID NO: 1128 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggaccgactggccatgtatt

SEQ ID NO: 1129 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgactggccatgtatgacgtt

SEQ ID NO: 1130 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctggagaagaggctcatcact

SEQ ID NO: 1131 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggagaagaggctcatcacct

SEQ ID NO: 1132 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggagaagaggctcatcacctt

SEQ ID NO: 1133 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gagaagaggctcatcacctct

SEQ ID NO: 1134 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaagaggctcatcacctcggt

SEQ ID NO: 1135 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aggctcatcacctcggtgtat

SEQ ID NO: 1136 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaagaagggcctgcacagctt

SEQ ID NO: 1137 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aagaagggcctgcacagctat

SEQ ID NO: 1138 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aagggcctgcacagctactat

SEQ ID NO: 1139 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agggcctgcacagctactact

SEQ ID NO: 1140 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctgcacagctactacgacct

SEQ ID NO: 1141 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctctctggactacggcttgt

SEQ ID NO: 1142 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tctctggactacggcttggct

SEQ ID NO: 1143 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggactacggcttggccctct

SEQ ID NO: 1144 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggactacggcttggccctctt

SEQ ID NO: 1145 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaggaggcagaagtatgattt

SEQ ID NO: 1146 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aggaggcagaagtatgatttt

SEQ ID NO: 1147 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agaagtatgatttgccgtgct

SEQ ID NO: 1148 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gaagtatgatttgccgtgcat

SEQ ID NO: 1149 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aagtatgatttgccgtgcact

SEQ ID NO: 1150 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agtatgatttgccgtgcacct

SEQ ID NO: 1151 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtatgatttgccgtgcaccct

SEQ ID NO: 1152 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggccagtggacgatccagaat

SEQ ID NO: 1153 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccagtggacgatccagaact

SEQ ID NO: 1154 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccagtggacgatccagaacat

SEQ ID NO: 1155 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagtggacgatccagaacagt

SEQ ID NO: 1156 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggacgatccagaacaggagt

SEQ ID NO: 1157 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccagaacaggaggctgtgtgt

SEQ ID NO: 1158 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agaacaggaggctgtgtggct

SEQ ID NO: 1159 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acttcacctcccagatctcct

SEQ ID NO: 1160 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cacctcccagatctccctcat

SEQ ID NO: 1161 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgtgcgggtgcactatggctt

SEQ ID NO: 1162 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgcgggtgcactatggcttt

SEQ ID NO: 1163 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcgggtgcactatggcttgt

SEQ ID NO: 1164 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcgggtgcactatggcttgtt

SEQ ID NO: 1165 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgggtgcactatggcttgtat

SEQ ID NO: 1166 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggtgcactatggcttgtact

SEQ ID NO: 1167 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggtgcactatggcttgtacat

SEQ ID NO: 1168 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcactatggcttgtacaact

SEQ ID NO: 1169 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcactatggcttgtacaacct

SEQ ID NO: 1170 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgccctggagagttcctctt

SEQ ID NO: 1171 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgccctggagagttcctctgt

SEQ ID NO: 1172 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
aacggcctggatgagagaaat

SEQ ID NO: 1173 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acggcctggatgagagaaact

SEQ ID NO: 1174 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cggcctggatgagagaaactt

SEQ ID NO: 1175 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcctggatgagagaaactgct

SEQ ID NO: 1176 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctggatgagagaaactgcgt

SEQ ID NO: 1177 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agagaaactgcgtttgcagat

SEQ ID NO: 1178 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gagaaactgcgtttgcagagt

SEQ ID NO: 1179 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgcgtttgcagagccacatt

SEQ ID NO: 1180 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcgtttgcagagccacattt

SEQ ID NO: 1181 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcgtttgcagagccacattct

SEQ ID NO: 1182 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgtttgcagagccacattcct

SEQ ID NO: 1183 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcagagccacattccagtgct

SEQ ID NO: 1184 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgggacattcaccttccagtt

SEQ ID NO: 1185 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggacattcaccttccagtgt

SEQ ID NO: 1186 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggacattcaccttccagtgtt

SEQ ID NO: 1187 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acattcaccttccagtgtgat

SEQ ID NO: 1188 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gagctgcgtgaagaagcccat

SEQ ID NO: 1189 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agctgcgtgaagaagcccaat

SEQ ID NO: 1190 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgcgtgaagaagcccaact

SEQ ID NO: 1191 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgcgtgaagaagcccaacct

SEQ ID NO: 1192 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcgtgaagaagcccaaccct

SEQ ID NO: 1193 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agcactgtgactgtggcctct

SEQ ID NO: 1194 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctccgagggtgagtggccatt

SEQ ID NO: 1195 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
atcgctgaccgctgggtgatt

SEQ ID NO: 1196 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcgctgaccgctgggtgatat

SEQ ID NO: 1197 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgctgaccgctgggtgataat

SEQ ID NO: 1198 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgaccgctgggtgataact

SEQ ID NO: 1199 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctgggtgataacagctgcct

SEQ ID NO: 1200 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcttccaggaggacagcatt

SEQ ID NO: 1201 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcttccaggaggacagcatgt

SEQ ID NO: 1202 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cttccaggaggacagcatggt

SEQ ID NO: 1203 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgtgttcctgggcaaggtgtt

SEQ ID NO: 1204 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgggcaaggtgtggcagaat

SEQ ID NO: 1205 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgggcaaggtgtggcagaact

SEQ ID NO: 1206 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gggcaaggtgtggcagaactt

SEQ ID NO: 1207 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggcaaggtgtggcagaactct

SEQ ID NO: 1208 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcaaggtgtggcagaactcgt

SEQ ID NO: 1209 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
caaggtgtggcagaactcgct

SEQ ID NO: 1210 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggcctggagaggtgtccttt

SEQ ID NO: 1211 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggcctggagaggtgtccttct

SEQ ID NO: 1212 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcctggagaggtgtccttcat

SEQ ID NO: 1213 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctggagaggtgtccttcaat

SEQ ID NO: 1214 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctggagaggtgtccttcaagt

SEQ ID NO: 1215 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
agaggtgtccttcaaggtgat

SEQ ID NO: 1216 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgtgcagttgatcccacaggt

SEQ ID NO: 1217 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgcagttgatcccacaggact

SEQ ID NO: 1218 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
atcccacaggacctgtgcagt

SEQ ID NO: 1219 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cccacaggacctgtgcagcgt

SEQ ID NO: 1220 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccacaggacctgtgcagcgat

SEQ ID NO: 1221 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccaggtgacgccacgcatgct

SEQ ID NO: 1222 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgacgccacgcatgctgtgt

SEQ ID NO: 1223 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tgacgccacgcatgctgtgtt

SEQ ID NO: 1224 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acgccacgcatgctgtgtgct

SEQ ID NO: 1225 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggctaccgcaagggcaagaat

SEQ ID NO: 1226 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gctaccgcaagggcaagaagt

SEQ ID NO: 1227 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctaccgcaagggcaagaaggt

SEQ ID NO: 1228 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgcaaggcactcagtggcct

SEQ ID NO: 1229 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctaactacttcggcgtctact

SEQ ID NO: 1230 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
actacttcggcgtctacacct

SEQ ID NO: 1231 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctacttcggcgtctacaccct

SEQ ID NO: 1232 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcgtctacacccgcatcacat

SEQ ID NO: 1233 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cgtctacacccgcatcacagt

SEQ ID NO: 1234 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctacacccgcatcacaggtgt

SEQ ID NO: 1235 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
acccgcatcacaggtgtgatt

SEQ ID NO: 1236 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cccgcatcacaggtgtgatct

SEQ ID NO: 1237 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggatccagcaagtggtgact

SEQ ID NO: 1238 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gatccagcaagtggtgacctt

SEQ ID NO: 1239 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
atccagcaagtggtgacctgt

SEQ ID NO: 1240 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccagcaagtggtgacctgagt

SEQ ID NO: 1241 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagcaagtggtgacctgaggt

SEQ ID NO: 1242 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gcaagtggtgacctgaggaat

SEQ ID NO: 1243 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggtggcaggaggtggcatct

SEQ ID NO: 1244 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggtggcaggaggtggcatctt

SEQ ID NO: 1245 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtggcaggaggtggcatcttt

SEQ ID NO: 1246 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggcaggaggtggcatcttgtt

SEQ ID NO: 1247 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tccctgatgtctgctccagtt

SEQ ID NO: 1248 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgatgtctgctccagtgatt

SEQ ID NO: 1249 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tccagtgatggcaggaggatt

SEQ ID NO: 1250 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ggctcagcagcaagaatgctt

SEQ ID NO: 1251 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctaacttgggatctgggaatt

SEQ ID NO: 1252 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ttgggatctgggaatggaagt

SEQ ID NO: 1253 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gtgagctcagctgccctttgt

SEQ ID NO: 1254 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctcagctgccctttggaatat

SEQ ID NO: 1255 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 10: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tcagctgccctttggaataat

SEQ ID NO: 1256 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 10: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cagctgccctttggaataaat

SEQ ID NO: 1257 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 10: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ctgccctttggaataaagctt

SEQ ID NO: 1258 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
gccctttggaataaagctgct

SEQ ID NO: 1259 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ccctttggaataaagctgcct

SEQ ID NO: 1260 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
cctttggaataaagctgcctt

SEQ ID NO: 1261 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tttggaataaagctgcctgat

SEQ ID NO: 1262 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
ttggaataaagctgcctgatt

SEQ ID NO: 1263 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
  misc_feature 1..8: note = RNA
  misc_feature 9: note = DNA
  misc_feature 10: note = RNA
  misc_feature 11: note = DNA
  misc_feature 12..21: note = RNA
tggaataaagctgcctgatct

SEQ ID NO: 1264 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acttcctcgccatcacctccgtc

SEQ ID NO: 1265 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcttcctcgccatcacctccgt

SEQ ID NO: 1266 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attggagtcctcacaggccttga

SEQ ID NO: 1267 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atcttggagtcctcacaggcctt

SEQ ID NO: 1268 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actcttggagtcctcacaggcct

SEQ ID NO: 1269 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atctcttggagtcctcacaggcc

SEQ ID NO: 1270 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
attctcttggagtcctcacaggc

SEQ ID NO: 1271 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acctaggaaataccagagtagca

SEQ ID NO: 1272 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
ataccctaggaaataccagagta

SEQ ID NO: 1273 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtaccctaggaaataccagagt

SEQ ID NO: 1274 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgtaccctaggaaataccagag

SEQ ID NO: 1275 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attgtaccctaggaaataccaga

SEQ ID NO: 1276 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acttgtaccctaggaaataccag

SEQ ID NO: 1277 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
accttgtaccctaggaaatacca

SEQ ID NO: 1278 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacctccgccttgtaccctagga

SEQ ID NO: 1279 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agagtacacctggctgaccatca

SEQ ID NO: 1280 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
actgagtacacctggctgaccat

SEQ ID NO: 1281 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acctgagtacacctggctgacca

SEQ ID NO: 1282 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcctgagtacacctggctgacc

SEQ ID NO: 1283 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgcctgagtacacctggctgac

SEQ ID NO: 1284 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
actgcctgagtacacctggctga

SEQ ID NO: 1285 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgggagaagtggcgattgagta

SEQ ID NO: 1286 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagatcctgggagaagtggcgat

SEQ ID NO: 1287 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaagatcctgggagaagtggcga

SEQ ID NO: 1288 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtaagatcctgggagaagtggc

SEQ ID NO: 1289 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcgggtaagatcctgggagaag

SEQ ID NO: 1290 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggcgggtaagatcctgggagaa

SEQ ID NO: 1291 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acggcgggtaagatcctgggaga

SEQ ID NO: 1292 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atttcactgcggaaggcactaga

SEQ ID NO: 1293 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcggtttcactgcggaaggcac

SEQ ID NO: 1294 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggcggtttcactgcggaaggca

SEQ ID NO: 1295 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atggcggtttcactgcggaaggc

SEQ ID NO: 1296 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actttggcggtttcactgcggaa

SEQ ID NO: 1297 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agctttggcggtttcactgcgga

SEQ ID NO: 1298 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggctttggcggtttcactgcgg

SEQ ID NO: 1299 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agggctttggcggtttcactgcg

SEQ ID NO: 1300 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atgggctttggcggtttcactgc

SEQ ID NO: 1301 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcatcttctgggctttggcggt

SEQ ID NO: 1302 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagcatcttctgggctttggcgg

SEQ ID NO: 1303 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
accttgagcatcttctgggcttt

SEQ ID NO: 1304 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaagttcccaggcgggtgctggt

SEQ ID NO: 1305 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
ataagttcccaggcgggtgctgg

SEQ ID NO: 1306 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatagacggagctggagttgtag

SEQ ID NO: 1307 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaatagacggagctggagttgta

SEQ ID NO: 1308 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agaaccagaagaagcaggtgagg

SEQ ID NO: 1309 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgaaccagaagaagcaggtgag

SEQ ID NO: 1310 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaatgaaccagaagaagcaggtg

SEQ ID NO: 1311 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agaatgaaccagaagaagcaggt

SEQ ID NO: 1312 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagaatgaaccagaagaagcagg

SEQ ID NO: 1313 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggagaatgaaccagaagaagca

SEQ ID NO: 1314 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atggagaatgaaccagaagaagc

SEQ ID NO: 1315 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attggagaatgaaccagaagaag

SEQ ID NO: 1316 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atttggagaatgaaccagaagaa

SEQ ID NO: 1317 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatttggagaatgaaccagaaga

SEQ ID NO: 1318 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agatttggagaatgaaccagaag

SEQ ID NO: 1319 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggatttggagaatgaaccagaa

SEQ ID NO: 1320 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtggacagcagctcctccacca

SEQ ID NO: 1321 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aactgtggacagcagctcctcca

SEQ ID NO: 1322 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttgactgtggacagcagctcc

SEQ ID NO: 1323 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgttgactgtggacagcagctc

SEQ ID NO: 1324 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagctgttgactgtggacagcag

SEQ ID NO: 1325 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agagctgttgactgtggacagca

SEQ ID NO: 1326 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acgagctgttgactgtggacagc

SEQ ID NO: 1327 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acacttcgtactcggccctgtag

SEQ ID NO: 1328 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtccacttcgtactcggccctg

SEQ ID NO: 1329 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggtccacttcgtactcggccct

SEQ ID NO: 1330 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attcacactggcttccaggatca

SEQ ID NO: 1331 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atttcacactggcttccaggatc

SEQ ID NO: 1332 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actttcacactggcttccaggat

SEQ ID NO: 1333 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atctttcacactggcttccagga

SEQ ID NO: 1334 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agtctttcacactggcttccagg

SEQ ID NO: 1335 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atgtctttcacactggcttccag

SEQ ID NO: 1336 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aatgtctttcacactggcttcca

SEQ ID NO: 1337 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atatgtctttcacactggcttcc

SEQ ID NO: 1338 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
actatgtctttcacactggcttc

SEQ ID NO: 1339 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agctatgtctttcacactggctt

SEQ ID NO: 1340 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagctatgtctttcacactggct

SEQ ID NO: 1341 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcagctatgtctttcacactgg

SEQ ID NO: 1342 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgcagctatgtctttcacactg

SEQ ID NO: 1343 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatgcagctatgtctttcacact

SEQ ID NO: 1344 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaatgcagctatgtctttcacac

SEQ ID NO: 1345 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaacccagcgtggaattcaatgc

SEQ ID NO: 1346 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
ataacaacccagcgtggaattca

SEQ ID NO: 1347 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagcggtaacaacccagcgtgga

SEQ ID NO: 1348 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atagcggtaacaacccagcgtgg

SEQ ID NO: 1349 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtagcggtaacaacccagcgtg

SEQ ID NO: 1350 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgtagcggtaacaacccagcgt

SEQ ID NO: 1351 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actgtagcggtaacaacccagcg

SEQ ID NO: 1352 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agctgtagcggtaacaacccagc

SEQ ID NO: 1353 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagctgtagcggtaacaacccag

SEQ ID NO: 1354 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atccactccagccggagtttgag

SEQ ID NO: 1355 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aatacatggccagtcggtcccgg

SEQ ID NO: 1356 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacgtcatacatggccagtcggt

SEQ ID NO: 1357 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtgatgagcctcttctccaggg

SEQ ID NO: 1358 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggtgatgagcctcttctccagg

SEQ ID NO: 1359 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaggtgatgagcctcttctccag

SEQ ID NO: 1360 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agaggtgatgagcctcttctcca

SEQ ID NO: 1361 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
accgaggtgatgagcctcttctc

SEQ ID NO: 1362 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atacaccgaggtgatgagcctct

SEQ ID NO: 1363 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagctgtgcaggcccttcttcca

SEQ ID NO: 1364 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atagctgtgcaggcccttcttcc

SEQ ID NO: 1365 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atagtagctgtgcaggcccttct

SEQ ID NO: 1366 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtagtagctgtgcaggcccttc

SEQ ID NO: 1367 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggtcgtagtagctgtgcaggcc

SEQ ID NO: 1368 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acaagccgtagtccagagagggc

SEQ ID NO: 1369 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agccaagccgtagtccagagagg

SEQ ID NO: 1370 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agagggccaagccgtagtccaga

SEQ ID NO: 1371 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagagggccaagccgtagtccag

SEQ ID NO: 1372 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aaatcatacttctgcctcctcag

SEQ ID NO: 1373 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaaatcatacttctgcctcctca

SEQ ID NO: 1374 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcacggcaaatcatacttctgc

SEQ ID NO: 1375 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgcacggcaaatcatacttctg

SEQ ID NO: 1376 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtgcacggcaaatcatacttct

SEQ ID NO: 1377 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggtgcacggcaaatcatacttc

SEQ ID NO: 1378 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agggtgcacggcaaatcatactt

SEQ ID NO: 1379 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attctggatcgtccactggccct

SEQ ID NO: 1380 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttctggatcgtccactggccc

SEQ ID NO: 1381 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atgttctggatcgtccactggcc

SEQ ID NO: 1382 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actgttctggatcgtccactggc

SEQ ID NO: 1383 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actcctgttctggatcgtccact

SEQ ID NO: 1384 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acacacagcctcctgttctggat

SEQ ID NO: 1385 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agccacacagcctcctgttctgg

SEQ ID NO: 1386 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggagatctgggaggtgaagttg

SEQ ID NO: 1387 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgagggagatctgggaggtgaa

SEQ ID NO: 1388 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagccatagtgcacccgcacacc

SEQ ID NO: 1389 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaagccatagtgcacccgcacac

SEQ ID NO: 1390 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acaagccatagtgcacccgcaca

SEQ ID NO: 1391 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacaagccatagtgcacccgcac

SEQ ID NO: 1392 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atacaagccatagtgcacccgca

SEQ ID NO: 1393 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtacaagccatagtgcacccgc

SEQ ID NO: 1394 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgtacaagccatagtgcacccg

SEQ ID NO: 1395 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttgtacaagccatagtgcacc

SEQ ID NO: 1396 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aggttgtacaagccatagtgcac

SEQ ID NO: 1397 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagaggaactctccagggcaggg

SEQ ID NO: 1398 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acagaggaactctccagggcagg

SEQ ID NO: 1399 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atttctctcatccaggccgttgg

SEQ ID NO: 1400 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agtttctctcatccaggccgttg

SEQ ID NO: 1401 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagtttctctcatccaggccgtt

SEQ ID NO: 1402 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcagtttctctcatccaggccg

SEQ ID NO: 1403 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acgcagtttctctcatccaggcc

SEQ ID NO: 1404 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atctgcaaacgcagtttctctca

SEQ ID NO: 1405 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actctgcaaacgcagtttctctc

SEQ ID NO: 1406 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatgtggctctgcaaacgcagtt

SEQ ID NO: 1407 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaatgtggctctgcaaacgcagt

SEQ ID NO: 1408 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agaatgtggctctgcaaacgcag

SEQ ID NO: 1409 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggaatgtggctctgcaaacgca

SEQ ID NO: 1410 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcactggaatgtggctctgcaa

SEQ ID NO: 1411 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aactggaaggtgaatgtcccaca

SEQ ID NO: 1412 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acactggaaggtgaatgtcccac

SEQ ID NO: 1413 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacactggaaggtgaatgtccca

SEQ ID NO: 1414 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atcacactggaaggtgaatgtcc

SEQ ID NO: 1415 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atgggcttcttcacgcagctccg

SEQ ID NO: 1416 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attgggcttcttcacgcagctcc

SEQ ID NO: 1417 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttgggcttcttcacgcagctc

SEQ ID NO: 1418 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggttgggcttcttcacgcagct

SEQ ID NO: 1419 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agggttgggcttcttcacgcagc

SEQ ID NO: 1420 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agaggccacagtcacagtgctcc

SEQ ID NO: 1421 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatggccactcaccctcggagga

SEQ ID NO: 1422 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatcacccagcggtcagcgatga

SEQ ID NO: 1423 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atatcacccagcggtcagcgatg

SEQ ID NO: 1424 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attatcacccagcggtcagcgat

SEQ ID NO: 1425 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttatcacccagcggtcagcga

SEQ ID NO: 1426 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggcagctgttatcacccagcgg

SEQ ID NO: 1427 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatgctgtcctcctggaagcagt

SEQ ID NO: 1428 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acatgctgtcctcctggaagcag

SEQ ID NO: 1429 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
accatgctgtcctcctggaagca

SEQ ID NO: 1430 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aacaccttgcccaggaacacggt

SEQ ID NO: 1431 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attctgccacaccttgcccagga

SEQ ID NO: 1432 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agttctgccacaccttgcccagg

SEQ ID NO: 1433 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagttctgccacaccttgcccag

SEQ ID NO: 1434 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agagttctgccacaccttgccca

SEQ ID NO: 1435 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acgagttctgccacaccttgccc

SEQ ID NO: 1436 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcgagttctgccacaccttgcc

SEQ ID NO: 1437 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaaggacacctctccaggccagc

SEQ ID NO: 1438 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agaaggacacctctccaggccag

SEQ ID NO: 1439 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atgaaggacacctctccaggcca

SEQ ID NO: 1440 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attgaaggacacctctccaggcc

SEQ ID NO: 1441 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acttgaaggacacctctccaggc

SEQ ID NO: 1442 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atcaccttgaaggacacctctcc

SEQ ID NO: 1443 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acctgtgggatcaactgcacatc

SEQ ID NO: 1444 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtcctgtgggatcaactgcaca

SEQ ID NO: 1445 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actgcacaggtcctgtgggatca

SEQ ID NO: 1446 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acgctgcacaggtcctgtgggat

SEQ ID NO: 1447 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atcgctgcacaggtcctgtggga

SEQ ID NO: 1448 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcatgcgtggcgtcacctggta

SEQ ID NO: 1449 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acacagcatgcgtggcgtcacct

SEQ ID NO: 1450 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacacagcatgcgtggcgtcacc

SEQ ID NO: 1451 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agcacacagcatgcgtggcgtca

SEQ ID NO: 1452 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attcttgcccttgcggtagccgg

SEQ ID NO: 1453 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
acttcttgcccttgcggtagccg

SEQ ID NO: 1454 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
accttcttgcccttgcggtagcc

SEQ ID NO: 1455 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggccactgagtgccttgcacac

SEQ ID NO: 1456 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtagacgccgaagtagttaggc

SEQ ID NO: 1457 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggtgtagacgccgaagtagtta

SEQ ID NO: 1458 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agggtgtagacgccgaagtagtt

SEQ ID NO: 1459 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atgtgatgcgggtgtagacgccg

SEQ ID NO: 1460 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actgtgatgcgggtgtagacgcc

SEQ ID NO: 1461 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acacctgtgatgcgggtgtagac

SEQ ID NO: 1462 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatcacacctgtgatgcgggtgt

SEQ ID NO: 1463 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agatcacacctgtgatgcgggtg

SEQ ID NO: 1464 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agtcaccacttgctggatccagc

SEQ ID NO: 1465 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaggtcaccacttgctggatcca

SEQ ID NO: 1466 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acaggtcaccacttgctggatcc

SEQ ID NO: 1467 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
actcaggtcaccacttgctggat

SEQ ID NO: 1468 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acctcaggtcaccacttgctgga

SEQ ID NO: 1469 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attcctcaggtcaccacttgctg

SEQ ID NO: 1470 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agatgccacctcctgccaccaca

SEQ ID NO: 1471 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aagatgccacctcctgccaccac

SEQ ID NO: 1472 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaagatgccacctcctgccacca

SEQ ID NO: 1473 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aacaagatgccacctcctgccac

SEQ ID NO: 1474 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aactggagcagacatcagggacg

SEQ ID NO: 1475 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aatcactggagcagacatcaggg

SEQ ID NO: 1476 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatcctcctgccatcactggagc

SEQ ID NO: 1477 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagcattcttgctgctgagccac

SEQ ID NO: 1478 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aattcccagatcccaagttagac

SEQ ID NO: 1479 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acttccattcccagatcccaagt

SEQ ID NO: 1480 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
acaaagggcagctgagctcacct

SEQ ID NO: 1481 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atattccaaagggcagctgagct

SEQ ID NO: 1482 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
attattccaaagggcagctgagc

SEQ ID NO: 1483 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
atttattccaaagggcagctgag

SEQ ID NO: 1484 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
aagctttattccaaagggcagct

SEQ ID NO: 1485 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..23: note = RNA
agcagctttattccaaagggcag

SEQ ID NO: 1486 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aggcagctttattccaaagggca

SEQ ID NO: 1487 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aaggcagctttattccaaagggc

SEQ ID NO: 1488 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
atcaggcagctttattccaaagg

SEQ ID NO: 1489 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
aatcaggcagctttattccaaag

SEQ ID NO: 1490 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..23: note = RNA
agatcaggcagctttattccaaa

SEQ ID NO: 1491 - RNA, 23 nt, Homo sapiens
  source 1..23: mol_type = unassigned RNA
gacggaggtgatggcgaggaagc

SEQ ID NO: 1492 - RNA, 23 nt, Homo sapiens
  source 1..23: mol_type = unassigned RNA
acggaggtgatggcgaggaagcg

SEQ ID NO: 1493 - RNA, 23 nt, Homo sapiens
  source 1..23: mol_type = unassigned RNA
tcaaggcctgtgaggactccaag

SEQ ID NO: 1494 - RNA, 23 nt, Homo sapiens
  source 1..23: mol_type = unassigned RNA
aaggcctgtgaggactccaagag

SEQ ID NO: 1495 - RNA, 23 nt, Homo sapiens
  source 1..23: mol_type = unassigned RNA
ggcctgtgaggactccaagagaa

SEQ ID NO: 1496 - RNA, 23 nt, Homo sapiens
  source 1..23: mol_type = unassigned RNA
gcctgtgaggactccaagagaaa

SEQ ID NO: 1497 - RNA, 23 nt, Homo sapiens
  source 1..23: mol_type = unassigned RNA
ctctggtatttcctagggtacaa

SEQ ID NO: 1498 - RNA, 23 nt, Homo sapiens
  source 1..23: mol_type = unassigned RNA
tctggtatttcctagggtacaag

SEQ ID NO: 1499 - RNA, 23 nt, Homo sapiens
  source 1..23: mol_type = unassigned RNA
ctggtatttcctagggtacaagg

SEQ ID NO: 1500 - RNA, 23 nt, Homo sapiens
  source 1..23: mol_type = unassigned RNA
tggtatttcctagggtacaaggc

SEQ ID NO: 1501 - RNA, 23 nt, Homo sapiens
  source 1..23: mol_type = unassigned RNA
tcctagggtacaaggcggaggtg

SEQ ID NO: 1502 - RNA, 23 nt, Homo sapiens
  source 1..23: mol_type = unassigned RNA
tgatggtcagccaggtgtactca

SEQ ID NO: 1503 - RNA, 23 nt, Homo sapiens
  source 1..23: mol_type = unassigned RNA
tggtcagccaggtgtactcaggc

SEQ ID NO: 1504 - RNA, 23 nt, Homo sapiens
  source 1..23: mol_type = unassigned RNA
ggtcagccaggtgtactcaggca

SEQ ID NO: 1505 - RNA, 23 nt, Homo sapiens
  source 1..23: mol_type = unassigned RNA
gtcagccaggtgtactcaggcag

SEQ ID NO: 1506 - RNA, 23 nt, Homo sapiens
  source 1..23: mol_type = unassigned RNA
tactcaatcgccacttctcccag

SEQ ID NO: 1507 - RNA, 23 nt, Homo sapiens
  source 1..23: mol_type = unassigned RNA
atcgccacttctcccaggatctt

SEQ ID NO: 1508 - RNA, 23 nt, Homo sapiens
  source 1..23: mol_type = unassigned RNA
gccacttctcccaggatcttacc

SEQ ID NO: 1509 - RNA, 23 nt, Homo sapiens
  source 1..23: mol_type = unassigned RNA
cttctcccaggatcttacccgcc

SEQ ID NO: 1510 - RNA, 23 nt, Homo sapiens
  source 1..23: mol_type = unassigned RNA
ttctcccaggatcttacccgccg

SEQ ID NO: 1511 - RNA, 23 nt, Homo sapiens
  source 1..23: mol_type = unassigned RNA
tctagtgccttccgcagtgaaac

SEQ ID NO: 1512 - RNA, 23 nt, Homo sapiens
  source 1..23: mol_type = unassigned RNA
tgccttccgcagtgaaaccgcca

SEQ ID NO: 1513 - RNA, 23 nt, Homo sapiens
  source 1..23: mol_type = unassigned RNA
gccttccgcagtgaaaccgccaa

SEQ ID NO: 1514 - RNA, 23 nt, Homo sapiens
  source 1..23: mol_type = unassigned RNA
ttccgcagtgaaaccgccaaagc

SEQ ID NO: 1515 - RNA, 23 nt, Homo sapiens
  source 1..23: mol_type = unassigned RNA
tccgcagtgaaaccgccaaagcc

SEQ ID NO: 1516 - RNA, 23 nt, Homo sapiens
  source 1..23: mol_type = unassigned RNA
ccgcagtgaaaccgccaaagccc

SEQ ID NO: 1517 - RNA, 23 nt, Homo sapiens
  source 1..23: mol_type = unassigned RNA
cgcagtgaaaccgccaaagccca

SEQ ID NO: 1518 - RNA, 23 nt, Homo sapiens
  source 1..23: mol_type = unassigned RNA
gcagtgaaaccgccaaagcccag

SEQ ID NO: 1519 - RNA, 23 nt, Homo sapiens
  source 1..23: mol_type = unassigned RNA
accgccaaagcccagaagatgct

SEQ ID NO: 1520 - RNA, 23 nt, Homo sapiens
  source 1..23: mol_type = unassigned RNA
ccgccaaagcccagaagatgctc

SEQ ID NO: 1521 - RNA, 23 nt, Homo sapiens
  source 1..23: mol_type = unassigned RNA
aaagcccagaagatgctcaagga

SEQ ID NO: 1522 - RNA, 23 nt, Homo sapiens
  source 1..23: mol_type = unassigned RNA
accagcacccgcctgggaactta

SEQ ID NO: 1523 - RNA, 23 nt, Homo sapiens
  source 1..23: mol_type = unassigned RNA
ccagcacccgcctgggaacttac

SEQ ID NO: 1524 - RNA, 23 nt, Homo sapiens
  source 1..23: mol_type = unassigned RNA
ctacaactccagctccgtctatt

SEQ ID NO: 1525 - RNA, 23 nt, Homo sapiens
  source 1..23: mol_type = unassigned RNA
ctcacctgcttcttctggttcat

SEQ ID NO: 1526 - RNA, 23 nt, Homo sapiens
  source 1..23: mol_type = unassigned RNA
acctgcttcttctggttcattct

SEQ ID NO: 1527 - RNA, 23 nt, Homo sapiens
  source 1..23: mol_type = unassigned RNA
cttcttctggttcattctccaaa

SEQ ID NO: 1528 - RNA, 23 nt, Homo sapiens
  source 1..23: mol_type = unassigned RNA
ttcttctggttcattctccaaat

SEQ ID NO: 1529 - RNA, 23 nt, Homo sapiens
  source 1..23: mol_type = unassigned RNA
tcttctggttcattctccaaatc

SEQ ID NO: 1530 - RNA, 23 nt, Homo sapiens
  source 1..23: mol_type = unassigned RNA
cttctggttcattctccaaatcc

SEQ ID NO: 1531 - RNA, 23 nt, Homo sapiens
  source 1..23: mol_type = unassigned RNA
tggtggaggagctgctgtccaca

SEQ ID NO: 1532 - RNA, 23 nt, Homo sapiens
  source 1..23: mol_type = unassigned RNA
tggaggagctgctgtccacagtc

SEQ ID NO: 1533 - RNA, 23 nt, Homo sapiens
  source 1..23: mol_type = unassigned RNA
ggagctgctgtccacagtcaaca

SEQ ID NO: 1534 - RNA, 23 nt, Homo sapiens
  source 1..23: mol_type = unassigned RNA
gagctgctgtccacagtcaacag

SEQ ID NO: 1535 - RNA, 23 nt, Homo sapiens
  source 1..23: mol_type = unassigned RNA
ctgctgtccacagtcaacagctc

SEQ ID NO: 1536 - RNA, 23 nt, Homo sapiens
  source 1..23: mol_type = unassigned RNA
tgctgtccacagtcaacagctcg

SEQ ID NO: 1537 - RNA, 23 nt, Homo sapiens
  source 1..23: mol_type = unassigned RNA
gctgtccacagtcaacagctcgg

SEQ ID NO: 1538 - RNA, 23 nt, Homo sapiens
  source 1..23: mol_type = unassigned RNA
cagggccgagtacgaagtggacc

SEQ ID NO: 1539 - RNA, 23 nt, Homo sapiens
  source 1..23: mol_type = unassigned RNA
agggccgagtacgaagtggaccc

SEQ ID NO: 1540 - RNA, 23 nt, Homo sapiens
  source 1..23: mol_type = unassigned RNA
tgatcctggaagccagtgtgaaa

SEQ ID NO: 1541 - RNA, 23 nt, Homo sapiens
  source 1..23: mol_type = unassigned RNA
gatcctggaagccagtgtgaaag

SEQ ID NO: 1542 - RNA, 23 nt, Homo sapiens
  source 1..23: mol_type = unassigned RNA
atcctggaagccagtgtgaaaga

SEQ ID NO: 1543 - RNA, 23 nt, Homo sapiens
  source 1..23: mol_type = unassigned RNA
tcctggaagccagtgtgaaagac

SEQ ID NO: 1544 - RNA, 23 nt, Homo sapiens
  source 1..23: mol_type = unassigned RNA
cctggaagccagtgtgaaagaca

SEQ ID NO: 1545 - RNA, 23 nt, Homo sapiens
  source 1..23: mol_type = unassigned RNA
ctggaagccagtgtgaaagacat

SEQ ID NO: 1546 - RNA, 23 nt, Homo sapiens
  source 1..23: mol_type = unassigned RNA
tggaagccagtgtgaaagacata

SEQ ID NO: 1547 - RNA, 23 nt, Homo sapiens
  source 1..23: mol_type = unassigned RNA
ggaagccagtgtgaaagacatag

SEQ ID NO: 1548 - RNA, 23 nt, Homo sapiens
  source 1..23: mol_type = unassigned RNA
gaagccagtgtgaaagacatagc

SEQ ID NO: 1549 - RNA, 23 nt, Homo sapiens
  source 1..23: mol_type = unassigned RNA
aagccagtgtgaaagacatagct

SEQ ID NO: 1550 - RNA, 23 nt, Homo sapiens
  source 1..23: mol_type = unassigned RNA
ccagtgtgaaagacatagctgca

SEQ ID NO: 1551 - RNA, 23 nt, Homo sapiens
  source 1..23: mol_type = unassigned RNA
cagtgtgaaagacatagctgcat

SEQ ID NO: 1552 - RNA, 23 nt, Homo sapiens
  source 1..23: mol_type = unassigned RNA
agtgtgaaagacatagctgcatt

SEQ ID NO: 1553 - RNA, 23 nt, Homo sapiens
  source 1..23: mol_type = unassigned RNA
gtgtgaaagacatagctgcattg

SEQ ID NO: 1554 - RNA, 23 nt, Homo sapiens
  source 1..23: mol_type = unassigned RNA
ccacgctgggttgttaccgctac

SEQ ID NO: 1555 - RNA, 23 nt, Homo sapiens
  source 1..23: mol_type = unassigned RNA
cacgctgggttgttaccgctaca

SEQ ID NO: 1556 - RNA, 23 nt, Homo sapiens
  source 1..23: mol_type = unassigned RNA
acgctgggttgttaccgctacag

SEQ ID NO: 1557 - RNA, 23 nt, Homo sapiens
  source 1..23: mol_type = unassigned RNA
gctgggttgttaccgctacagct

SEQ ID NO: 1558 - RNA, 23 nt, Homo sapiens
  source 1..23: mol_type = unassigned RNA
ctgggttgttaccgctacagcta

SEQ ID NO: 1559 - RNA, 23 nt, Homo sapiens
  source 1..23: mol_type = unassigned RNA
ctcaaactccggctggagtggac

SEQ ID NO: 1560 - RNA, 23 nt, Homo sapiens
  source 1..23: mol_type = unassigned RNA
accgactggccatgtatgacgtg

SEQ ID NO: 1561 - RNA, 23 nt, Homo sapiens
  source 1..23: mol_type = unassigned RNA
ccctggagaagaggctcatcacc

SEQ ID NO: 1562 - RNA, 23 nt, Homo sapiens
  source 1..23: mol_type = unassigned RNA
cctggagaagaggctcatcacct

SEQ ID NO: 1563 - RNA, 23 nt, Homo sapiens
  source 1..23: mol_type = unassigned RNA
ctggagaagaggctcatcacctc

SEQ ID NO: 1564 - RNA, 23 nt, Homo sapiens
  source 1..23: mol_type = unassigned RNA
tggagaagaggctcatcacctcg

SEQ ID NO: 1565 - RNA, 23 nt, Homo sapiens
  source 1..23: mol_type = unassigned RNA
gagaagaggctcatcacctcggt

SEQ ID NO: 1566 - RNA, 23 nt, Homo sapiens
  source 1..23: mol_type = unassigned RNA
tggaagaagggcctgcacagcta

SEQ ID NO: 1567 - RNA, 23 nt, Homo sapiens
  source 1..23: mol_type = unassigned RNA
ggaagaagggcctgcacagctac

SEQ ID NO: 1568 - RNA, 23 nt, Homo sapiens
  source 1..23: mol_type = unassigned RNA
agaagggcctgcacagctactac

SEQ ID NO: 1569 - RNA, 23 nt, Homo sapiens
  source 1..23: mol_type = unassigned RNA
gaagggcctgcacagctactacg

SEQ ID NO: 1570 - RNA, 23 nt, Homo sapiens
  source 1..23: mol_type = unassigned RNA
tctggactacggcttggccctct

SEQ ID NO: 1571 - RNA, 23 nt, Homo sapiens
  source 1..23: mol_type = unassigned RNA
ctggactacggcttggccctctg

SEQ ID NO: 1572 - RNA, 23 nt, Homo sapiens
  source 1..23: mol_type = unassigned RNA
tgaggaggcagaagtatgatttg

SEQ ID NO: 1573 - RNA, 23 nt, Homo sapiens
  source 1..23: mol_type = unassigned RNA
agaagtatgatttgccgtgcacc

SEQ ID NO: 1574 - RNA, 23 nt, Homo sapiens
  source 1..23: mol_type = unassigned RNA
gaagtatgatttgccgtgcaccc

SEQ ID NO: 1575 - RNA, 23 nt, Homo sapiens
  source 1..23: mol_type = unassigned RNA
aagtatgatttgccgtgcaccca

SEQ ID NO: 1576 - RNA, 23 nt, Homo sapiens
  source 1..23: mol_type = unassigned RNA
agggccagtggacgatccagaac

SEQ ID NO: 1577 - RNA, 23 nt, Homo sapiens
  source 1..23: mol_type = unassigned RNA
gggccagtggacgatccagaaca

SEQ ID NO: 1578 - RNA, 23 nt, Homo sapiens
  source 1..23: mol_type = unassigned RNA
ggccagtggacgatccagaacag

SEQ ID NO: 1579 - RNA, 23 nt, Homo sapiens
  source 1..23: mol_type = unassigned RNA
agtggacgatccagaacaggagg

SEQ ID NO: 1580 - RNA, 23 nt, Homo sapiens
  source 1..23: mol_type = unassigned RNA
caacttcacctcccagatctccc

SEQ ID NO: 1581 - RNA, 23 nt, Homo sapiens
  source 1..23: mol_type = unassigned RNA
ttcacctcccagatctccctcac

SEQ ID NO: 1582 - RNA, 23 nt, Homo sapiens
  source 1..23: mol_type = unassigned RNA
tgtgcgggtgcactatggcttgt

SEQ ID NO: 1583 - RNA, 23 nt, Homo sapiens
  source 1..23: mol_type = unassigned RNA
tgcgggtgcactatggcttgtac

SEQ ID NO: 1584 - RNA, 23 nt, Homo sapiens
  source 1..23: mol_type = unassigned RNA
cgggtgcactatggcttgtacaa

SEQ ID NO: 1585 - RNA, 23 nt, Homo sapiens
  source 1..23: mol_type = unassigned RNA
ggtgcactatggcttgtacaacc

SEQ ID NO: 1586 - RNA, 23 nt, Homo sapiens
  source 1..23: mol_type = unassigned RNA
gtgcactatggcttgtacaacca

SEQ ID NO: 1587 - RNA, 23 nt, Homo sapiens
  source 1..23: mol_type = unassigned RNA
cctgccctggagagttcctctgt

SEQ ID NO: 1588 - RNA, 23 nt, Homo sapiens
  source 1..23: mol_type = unassigned RNA
ccaacggcctggatgagagaaac

SEQ ID NO: 1589 - RNA, 23 nt, Homo sapiens
  source 1..23: mol_type = unassigned RNA
caacggcctggatgagagaaact

SEQ ID NO: 1590 - RNA, 23 nt, Homo sapiens
  source 1..23: mol_type = unassigned RNA
aacggcctggatgagagaaactg

SEQ ID NO: 1591 - RNA, 23 nt, Homo sapiens
  source 1..23: mol_type = unassigned RNA
ggcctggatgagagaaactgcgt

SEQ ID NO: 1592 - RNA, 23 nt, Homo sapiens
  source 1..23: mol_type = unassigned RNA
tgagagaaactgcgtttgcagag

SEQ ID NO: 1593 - RNA, 23 nt, Homo sapiens
  source 1..23: mol_type = unassigned RNA
gagagaaactgcgtttgcagagc

SEQ ID NO: 1594 - RNA, 23 nt, Homo sapiens
  source 1..23: mol_type = unassigned RNA
aactgcgtttgcagagccacatt

SEQ ID NO: 1595 - RNA, 23 nt, Homo sapiens
  source 1..23: mol_type = unassigned RNA
actgcgtttgcagagccacattc

SEQ ID NO: 1596 - RNA, 23 nt, Homo sapiens
  source 1..23: mol_type = unassigned RNA
ctgcgtttgcagagccacattcc

SEQ ID NO: 1597 - RNA, 23 nt, Homo sapiens
  source 1..23: mol_type = unassigned RNA
tgcgtttgcagagccacattcca

SEQ ID NO: 1598 - RNA, 23 nt, Homo sapiens
  source 1..23: mol_type = unassigned RNA
ttgcagagccacattccagtgca

SEQ ID NO: 1599 - RNA, 23 nt, Homo sapiens
  source 1..23: mol_type = unassigned RNA
gtgggacattcaccttccagtgt

SEQ ID NO: 1600 - RNA, 23 nt, Homo sapiens
  source 1..23: mol_type = unassigned RNA
cggagctgcgtgaagaagcccaa

SEQ ID NO: 1601 - RNA, 23 nt, Homo sapiens
  source 1..23: mol_type = unassigned RNA
ggagctgcgtgaagaagcccaac

SEQ ID NO: 1602 - RNA, 23 nt, Homo sapiens
  source 1..23: mol_type = unassigned RNA
gagctgcgtgaagaagcccaacc

SEQ ID NO: 1603 - RNA, 23 nt, Homo sapiens
  source 1..23: mol_type = unassigned RNA
agctgcgtgaagaagcccaaccc

SEQ ID NO: 1604 - RNA, 23 nt, Homo sapiens
  source 1..23: mol_type = unassigned RNA
gctgcgtgaagaagcccaacccg

SEQ ID NO: 1605 - RNA, 23 nt, Homo sapiens
  source 1..23: mol_type = unassigned RNA
ggagcactgtgactgtggcctcc

SEQ ID NO: 1606 - RNA, 23 nt, Homo sapiens
  source 1..23: mol_type = unassigned RNA
tcctccgagggtgagtggccatg

SEQ ID NO: 1607 - RNA, 23 nt, Homo sapiens
  source 1..23: mol_type = unassigned RNA
catcgctgaccgctgggtgataa

SEQ ID NO: 1608 - RNA, 23 nt, Homo sapiens
  source 1..23: mol_type = unassigned RNA
atcgctgaccgctgggtgataac

SEQ ID NO: 1609 - RNA, 23 nt, Homo sapiens
  source 1..23: mol_type = unassigned RNA
tcgctgaccgctgggtgataaca

SEQ ID NO: 1610 - RNA, 23 nt, Homo sapiens
  source 1..23: mol_type = unassigned RNA
ccgctgggtgataacagctgccc

SEQ ID NO: 1611 - RNA, 23 nt, Homo sapiens
  source 1..23: mol_type = unassigned RNA
actgcttccaggaggacagcatg

SEQ ID NO: 1612 - RNA, 23 nt, Homo sapiens
  source 1..23: mol_type = unassigned RNA
ctgcttccaggaggacagcatgg

SEQ ID NO: 1613 - RNA, 23 nt, Homo sapiens
  source 1..23: mol_type = unassigned RNA
tgcttccaggaggacagcatggc

SEQ ID NO: 1614 - RNA, 23 nt, Homo sapiens
  source 1..23: mol_type = unassigned RNA
tcctgggcaaggtgtggcagaac

SEQ ID NO: 1615 - RNA, 23 nt, Homo sapiens
  source 1..23: mol_type = unassigned RNA
cctgggcaaggtgtggcagaact

SEQ ID NO: 1616 - RNA, 23 nt, Homo sapiens
  source 1..23: mol_type = unassigned RNA
ctgggcaaggtgtggcagaactc

SEQ ID NO: 1617 - RNA, 23 nt, Homo sapiens
  source 1..23: mol_type = unassigned RNA
tgggcaaggtgtggcagaactcg

SEQ ID NO: 1618 - RNA, 23 nt, Homo sapiens
  source 1..23: mol_type = unassigned RNA
ggcaaggtgtggcagaactcgcg

SEQ ID NO: 1619 - RNA, 23 nt, Homo sapiens
  source 1..23: mol_type = unassigned RNA
gctggcctggagaggtgtccttc

SEQ ID NO: 1620 - RNA, 23 nt, Homo sapiens
  source 1..23: mol_type = unassigned RNA
ctggcctggagaggtgtccttca

SEQ ID NO: 1621 - RNA, 23 nt, Homo sapiens
  source 1..23: mol_type = unassigned RNA
tggcctggagaggtgtccttcaa

SEQ ID NO: 1622 - RNA, 23 nt, Homo sapiens
  source 1..23: mol_type = unassigned RNA
ggcctggagaggtgtccttcaag

SEQ ID NO: 1623 - RNA, 23 nt, Homo sapiens
  source 1..23: mol_type = unassigned RNA
gatgtgcagttgatcccacagga

SEQ ID NO: 1624 - RNA, 23 nt, Homo sapiens
  source 1..23: mol_type = unassigned RNA
tgtgcagttgatcccacaggacc

SEQ ID NO: 1625 - RNA, 23 nt, Homo sapiens
  source 1..23: mol_type = unassigned RNA
atcccacaggacctgtgcagcga

SEQ ID NO: 1626 - RNA, 23 nt, Homo sapiens
  source 1..23: mol_type = unassigned RNA
tcccacaggacctgtgcagcgag

SEQ ID NO: 1627 - RNA, 23 nt, Homo sapiens
  source 1..23: mol_type = unassigned RNA
taccaggtgacgccacgcatgct

SEQ ID NO: 1628 - RNA, 23 nt, Homo sapiens
  source 1..23: mol_type = unassigned RNA
aggtgacgccacgcatgctgtgt

SEQ ID NO: 1629 - RNA, 23 nt, Homo sapiens
  source 1..23: mol_type = unassigned RNA
tgacgccacgcatgctgtgtgcc

SEQ ID NO: 1630 - RNA, 23 nt, Homo sapiens
  source 1..23: mol_type = unassigned RNA
ccggctaccgcaagggcaagaag

SEQ ID NO: 1631 - RNA, 23 nt, Homo sapiens
  source 1..23: mol_type = unassigned RNA
gtgtgcaaggcactcagtggccg

SEQ ID NO: 1632 - RNA, 23 nt, Homo sapiens
  source 1..23: mol_type = unassigned RNA
gcctaactacttcggcgtctaca

SEQ ID NO: 1633 - RNA, 23 nt, Homo sapiens
  source 1..23: mol_type = unassigned RNA
taactacttcggcgtctacaccc

SEQ ID NO: 1634 - RNA, 23 nt, Homo sapiens
  source 1..23: mol_type = unassigned RNA
aactacttcggcgtctacacccg

SEQ ID NO: 1635 - RNA, 23 nt, Homo sapiens
  source 1..23: mol_type = unassigned RNA
cggcgtctacacccgcatcacag

SEQ ID NO: 1636 - RNA, 23 nt, Homo sapiens
  source 1..23: mol_type = unassigned RNA
ggcgtctacacccgcatcacagg

SEQ ID NO: 1637 - RNA, 23 nt, Homo sapiens
  source 1..23: mol_type = unassigned RNA
acacccgcatcacaggtgtgatc

SEQ ID NO: 1638 - RNA, 23 nt, Homo sapiens
  source 1..23: mol_type = unassigned RNA
cacccgcatcacaggtgtgatca

SEQ ID NO: 1639 - RNA, 23 nt, Homo sapiens
  source 1..23: mol_type = unassigned RNA
gctggatccagcaagtggtgacc

SEQ ID NO: 1640 - RNA, 23 nt, Homo sapiens
  source 1..23: mol_type = unassigned RNA
tggatccagcaagtggtgacctg

SEQ ID NO: 1641 - RNA, 23 nt, Homo sapiens
  source 1..23: mol_type = unassigned RNA
ggatccagcaagtggtgacctga

SEQ ID NO: 1642 - RNA, 23 nt, Homo sapiens
  source 1..23: mol_type = unassigned RNA
atccagcaagtggtgacctgagg

SEQ ID NO: 1643 - RNA, 23 nt, Homo sapiens
  source 1..23: mol_type = unassigned RNA
tccagcaagtggtgacctgagga

SEQ ID NO: 1644 - RNA, 23 nt, Homo sapiens
  source 1..23: mol_type = unassigned RNA
cagcaagtggtgacctgaggaac

SEQ ID NO: 1645 - RNA, 23 nt, Homo sapiens
  source 1..23: mol_type = unassigned RNA
tgtggtggcaggaggtggcatct

SEQ ID NO: 1646 - RNA, 23 nt, Homo sapiens
  source 1..23: mol_type = unassigned RNA
gtggtggcaggaggtggcatctt

SEQ ID NO: 1647 - RNA, 23 nt, Homo sapiens
  source 1..23: mol_type = unassigned RNA
tggtggcaggaggtggcatcttg

SEQ ID NO: 1648 - RNA, 23 nt, Homo sapiens
  source 1..23: mol_type = unassigned RNA
cgtccctgatgtctgctccagtg

SEQ ID NO: 1649 - RNA, 23 nt, Homo sapiens
  source 1..23: mol_type = unassigned RNA
ccctgatgtctgctccagtgatg

SEQ ID NO: 1650 - RNA, 23 nt, Homo sapiens
  source 1..23: mol_type = unassigned RNA
gctccagtgatggcaggaggatg

SEQ ID NO: 1651 - RNA, 23 nt, Homo sapiens
  source 1..23: mol_type = unassigned RNA
gtctaacttgggatctgggaatg

SEQ ID NO: 1652 - RNA, 23 nt, Homo sapiens
  source 1..23: mol_type = unassigned RNA
aggtgagctcagctgccctttgg

SEQ ID NO: 1653 - RNA, 23 nt, Homo sapiens
  source 1..23: mol_type = unassigned RNA
agctcagctgccctttggaataa

SEQ ID NO: 1654 - RNA, 23 nt, Homo sapiens
  source 1..23: mol_type = unassigned RNA
gctcagctgccctttggaataaa

SEQ ID NO: 1655 - RNA, 23 nt, Homo sapiens
  source 1..23: mol_type = unassigned RNA
ctcagctgccctttggaataaag

SEQ ID NO: 1656 - RNA, 23 nt, Homo sapiens
  source 1..23: mol_type = unassigned RNA
ctgccctttggaataaagctgcc

SEQ ID NO: 1657 - RNA, 23 nt, Homo sapiens
  source 1..23: mol_type = unassigned RNA
tgccctttggaataaagctgcct

SEQ ID NO: 1658 - RNA, 23 nt, Homo sapiens
  source 1..23: mol_type = unassigned RNA
gccctttggaataaagctgcctg

SEQ ID NO: 1659 - RNA, 23 nt, Homo sapiens
  source 1..23: mol_type = unassigned RNA
cctttggaataaagctgcctgat

SEQ ID NO: 1660 - RNA, 23 nt, Homo sapiens
  source 1..23: mol_type = unassigned RNA
ctttggaataaagctgcctgatc

SEQ ID NO: 1661 - RNA, 23 nt, Homo sapiens
  source 1..23: mol_type = unassigned RNA
tttggaataaagctgcctgatcc

SEQ ID NO: 1662 - RNA, 21 nt, synthetic construct
  source 1..21: mol_type = other RNA; note = Description of Artificial Sequence: Synthetic oligonucleotide
ctgtgaggactccaagagaat

SEQ ID NO: 1663 - RNA, 21 nt, synthetic construct
  source 1..21: mol_type = other RNA; note = Description of Artificial Sequence: Synthetic oligonucleotide
gtatttcctagggtacaaggt

SEQ ID NO: 1664 - RNA, 21 nt, synthetic construct
  source 1..21: mol_type = other RNA; note = Description of Artificial Sequence: Synthetic oligonucleotide
tctcccaggatcttacccgct

SEQ ID NO: 1665 - RNA, 21 nt, synthetic construct
  source 1..21: mol_type = other RNA; note = Description of Artificial Sequence: Synthetic oligonucleotide
ccttccgcagtgaaaccgcct

SEQ ID NO: 1666 - RNA, 21 nt, synthetic construct
  source 1..21: mol_type = other RNA; note = Description of Artificial Sequence: Synthetic oligonucleotide
agcacccgcctgggaacttat

SEQ ID NO: 1667 - RNA, 21 nt, synthetic construct
  source 1..21: mol_type = other RNA; note = Description of Artificial Sequence: Synthetic oligonucleotide
ctgcttcttctggttcattct

SEQ ID NO: 1668 - RNA, 21 nt, synthetic construct
  source 1..21: mol_type = other RNA; note = Description of Artificial Sequence: Synthetic oligonucleotide
cttctggttcattctccaaat

SEQ ID NO: 1669 - RNA, 21 nt, synthetic construct
  source 1..21: mol_type = other RNA; note = Description of Artificial Sequence: Synthetic oligonucleotide
tggaagccagtgtgaaagact

SEQ ID NO: 1670 - RNA, 21 nt, synthetic construct
  source 1..21: mol_type = other RNA; note = Description of Artificial Sequence: Synthetic oligonucleotide
gaagccagtgtgaaagacatt

SEQ ID NO: 1671 - RNA, 21 nt, synthetic construct
  source 1..21: mol_type = other RNA; note = Description of Artificial Sequence: Synthetic oligonucleotide
agccagtgtgaaagacatagt

SEQ ID NO: 1672 - RNA, 21 nt, synthetic construct
  source 1..21: mol_type = other RNA; note = Description of Artificial Sequence: Synthetic oligonucleotide
gtgaaagacatagctgcattt

SEQ ID NO: 1673 - RNA, 21 nt, synthetic construct
  source 1..21: mol_type = other RNA; note = Description of Artificial Sequence: Synthetic oligonucleotide
tgggttgttaccgctacagct

SEQ ID NO: 1674 - RNA, 21 nt, synthetic construct
  source 1..21: mol_type = other RNA; note = Description of Artificial Sequence: Synthetic oligonucleotide
cgactggccatgtatgacgtt

SEQ ID NO: 1675 - RNA, 21 nt, synthetic construct
  source 1..21: mol_type = other RNA; note = Description of Artificial Sequence: Synthetic oligonucleotide
agtatgatttgccgtgcacct

SEQ ID NO: 1676 - RNA, 21 nt, synthetic construct
  source 1..21: mol_type = other RNA; note = Description of Artificial Sequence: Synthetic oligonucleotide
acttcacctcccagatctcct

SEQ ID NO: 1677 - RNA, 21 nt, synthetic construct
  source 1..21: mol_type = other RNA; note = Description of Artificial Sequence: Synthetic oligonucleotide
gcactatggcttgtacaacct

SEQ ID NO: 1678 - RNA, 21 nt, synthetic construct
  source 1..21: mol_type = other RNA; note = Description of Artificial Sequence: Synthetic oligonucleotide
acggcctggatgagagaaact

SEQ ID NO: 1679 - RNA, 21 nt, synthetic construct
  source 1..21: mol_type = other RNA; note = Description of Artificial Sequence: Synthetic oligonucleotide
agagaaactgcgtttgcagat

SEQ ID NO: 1680 - RNA, 21 nt, synthetic construct
  source 1..21: mol_type = other RNA; note = Description of Artificial Sequence: Synthetic oligonucleotide
gagctgcgtgaagaagcccat

SEQ ID NO: 1681 - RNA, 21 nt, synthetic construct
  source 1..21: mol_type = other RNA; note = Description of Artificial Sequence: Synthetic oligonucleotide
cgctgaccgctgggtgataat

SEQ ID NO: 1682 - RNA, 21 nt, synthetic construct
  source 1..21: mol_type = other RNA; note = Description of Artificial Sequence: Synthetic oligonucleotide
gggcaaggtgtggcagaactt

SEQ ID NO: 1683 - RNA, 21 nt, synthetic construct
  source 1..21: mol_type = other RNA; note = Description of Artificial Sequence: Synthetic oligonucleotide
ctgatgtctgctccagtgatt

SEQ ID NO: 1684 - RNA, 21 nt, synthetic construct
  source 1..21: mol_type = other RNA; note = Description of Artificial Sequence: Synthetic oligonucleotide
cagctgccctttggaataaat

SEQ ID NO: 1685 - RNA, 21 nt, synthetic construct
  source 1..21: mol_type = other RNA; note = Description of Artificial Sequence: Synthetic oligonucleotide
cctcacctgcttcttctggtt

SEQ ID NO: 1686 - RNA, 19 nt, synthetic construct
  source 1..19: mol_type = other RNA; note = Description of Artificial Sequence: Synthetic oligonucleotide
tcacctgcttcttctggtt

SEQ ID NO: 1687 - RNA, 17 nt, synthetic construct
  source 1..17: mol_type = other RNA; note = Description of Artificial Sequence: Synthetic oligonucleotide
acctgcttcttctggtt

SEQ ID NO: 1688 - RNA, 21 nt, synthetic construct
  source 1..21: mol_type = other RNA; note = Description of Artificial Sequence: Synthetic oligonucleotide
ggaggtgatggcgaggaagct

SEQ ID NO: 1689 - RNA, 21 nt, synthetic construct
  source 1..21: mol_type = other RNA; note = Description of Artificial Sequence: Synthetic oligonucleotide
aaggcctgtgaggactccaat

SEQ ID NO: 1690 - RNA, 21 nt, synthetic construct
  source 1..21: mol_type = other RNA; note = Description of Artificial Sequence: Synthetic oligonucleotide
ctggtatttcctagggtacat

SEQ ID NO: 1691 - RNA, 21 nt, synthetic construct
  source 1..21: mol_type = other RNA; note = Description of Artificial Sequence: Synthetic oligonucleotide
tggtatttcctagggtacaat

SEQ ID NO: 1692 - RNA, 21 nt, synthetic construct
  source 1..21: mol_type = other RNA; note = Description of Artificial Sequence: Synthetic oligonucleotide
gtcagccaggtgtactcaggt

SEQ ID NO: 1693 - RNA, 21 nt, synthetic construct
  source 1..21: mol_type = other RNA; note = Description of Artificial Sequence: Synthetic oligonucleotide
cagccaggtgtactcaggcat

SEQ ID NO: 1694 - RNA, 21 nt, synthetic construct
  source 1..21: mol_type = other RNA; note = Description of Artificial Sequence: Synthetic oligonucleotide
tagtgccttccgcagtgaaat

SEQ ID NO: 1695 - RNA, 21 nt, synthetic construct
  source 1..21: mol_type = other RNA; note = Description of Artificial Sequence: Synthetic oligonucleotide
cacctgcttcttctggttcat

SEQ ID NO: 1696 - RNA, 21 nt, synthetic construct
  source 1..21: mol_type = other RNA; note = Description of Artificial Sequence: Synthetic oligonucleotide
tcttctggttcattctccaat

SEQ ID NO: 1697 - RNA, 21 nt, synthetic construct
  source 1..21: mol_type = other RNA; note = Description of Artificial Sequence: Synthetic oligonucleotide
ttctggttcattctccaaatt

SEQ ID NO: 1698 - RNA, 21 nt, synthetic construct
  source 1..21: mol_type = other RNA; note = Description of Artificial Sequence: Synthetic oligonucleotide
tctggttcattctccaaatct

SEQ ID NO: 1699 - RNA, 21 nt, synthetic construct
  source 1..21: mol_type = other RNA; note = Description of Artificial Sequence: Synthetic oligonucleotide
gtggaggagctgctgtccact

SEQ ID NO: 1700 - RNA, 21 nt, synthetic construct
  source 1..21: mol_type = other RNA; note = Description of Artificial Sequence: Synthetic oligonucleotide
gaggagctgctgtccacagtt

SEQ ID NO: 1701 - RNA, 21 nt, synthetic construct
  source 1..21: mol_type = other RNA; note = Description of Artificial Sequence: Synthetic oligonucleotide
agctgctgtccacagtcaact

SEQ ID NO: 1702 - RNA, 21 nt, synthetic construct
  source 1..21: mol_type = other RNA; note = Description of Artificial Sequence: Synthetic oligonucleotide
ctgtccacagtcaacagctct

SEQ ID NO: 1703 - RNA, 21 nt, synthetic construct
  source 1..21: mol_type = other RNA; note = Description of Artificial Sequence: Synthetic oligonucleotide
gggccgagtacgaagtggact

SEQ ID NO: 1704 - RNA, 21 nt, synthetic construct
  source 1..21: mol_type = other RNA; note = Description of Artificial Sequence: Synthetic oligonucleotide
acgctgggttgttaccgctat

SEQ ID NO: 1705 - RNA, 21 nt, synthetic construct
  source 1..21: mol_type = other RNA; note = Description of Artificial Sequence: Synthetic oligonucleotide
cgctgggttgttaccgctact

SEQ ID NO: 1706 - RNA, 21 nt, synthetic construct
  source 1..21: mol_type = other RNA; note = Description of Artificial Sequence: Synthetic oligonucleotide
gctgggttgttaccgctacat

SEQ ID NO: 1707 - RNA, 21 nt, synthetic construct
  source 1..21: mol_type = other RNA; note = Description of Artificial Sequence: Synthetic oligonucleotide
gagaagaggctcatcacctct

SEQ ID NO: 1708 - RNA, 21 nt, synthetic construct
  source 1..21: mol_type = other RNA; note = Description of Artificial Sequence: Synthetic oligonucleotide
gaagaggctcatcacctcggt

SEQ ID NO: 1709 - RNA, 21 nt, synthetic construct
  source 1..21: mol_type = other RNA; note = Description of Artificial Sequence: Synthetic oligonucleotide
aagaagggcctgcacagctat

SEQ ID NO: 1710 - RNA, 21 nt, synthetic construct
  source 1..21: mol_type = other RNA; note = Description of Artificial Sequence: Synthetic oligonucleotide
ggactacggcttggccctctt

SEQ ID NO: 1711 - RNA, 21 nt, synthetic construct
  source 1..21: mol_type = other RNA; note = Description of Artificial Sequence: Synthetic oligonucleotide
aagtatgatttgccgtgcact

SEQ ID NO: 1712 - RNA, 21 nt, synthetic construct
  source 1..21: mol_type = other RNA; note = Description of Artificial Sequence: Synthetic oligonucleotide
gtatgatttgccgtgcaccct

SEQ ID NO: 1713 - RNA, 21 nt, synthetic construct
  source 1..21: mol_type = other RNA; note = Description of Artificial Sequence: Synthetic oligonucleotide
ctgggcaaggtgtggcagaat

SEQ ID NO: 1714 - RNA, 21 nt, synthetic construct
  source 1..21: mol_type = other RNA; note = Description of Artificial Sequence: Synthetic oligonucleotide
cctggagaggtgtccttcaat

SEQ ID NO: 1715 - RNA, 21 nt, synthetic construct
  source 1..21: mol_type = other RNA; note = Description of Artificial Sequence: Synthetic oligonucleotide
tgtgcagttgatcccacaggt

SEQ ID NO: 1716 - RNA, 21 nt, synthetic construct
  source 1..21: mol_type = other RNA; note = Description of Artificial Sequence: Synthetic oligonucleotide
ccacaggacctgtgcagcgat

SEQ ID NO: 1717 - RNA, 21 nt, synthetic construct
  source 1..21: mol_type = other RNA; note = Description of Artificial Sequence: Synthetic oligonucleotide
acgccacgcatgctgtgtgct

SEQ ID NO: 1718 - RNA, 21 nt, synthetic construct
  source 1..21: mol_type = other RNA; note = Description of Artificial Sequence: Synthetic oligonucleotide
ctaactacttcggcgtctact

SEQ ID NO: 1719 - RNA, 21 nt, synthetic construct
  source 1..21: mol_type = other RNA; note = Description of Artificial Sequence: Synthetic oligonucleotide
atccagcaagtggtgacctgt

SEQ ID NO: 1720 - RNA, 21 nt, synthetic construct
  source 1..21: mol_type = other RNA; note = Description of Artificial Sequence: Synthetic oligonucleotide
ccagcaagtggtgacctgagt

SEQ ID NO: 1721 - RNA, 21 nt, synthetic construct
  source 1..21: mol_type = other RNA; note = Description of Artificial Sequence: Synthetic oligonucleotide
cagcaagtggtgacctgaggt

SEQ ID NO: 1722 - RNA, 21 nt, synthetic construct
  source 1..21: mol_type = other RNA; note = Description of Artificial Sequence: Synthetic oligonucleotide
gcaagtggtgacctgaggaat

SEQ ID NO: 1723 - RNA, 21 nt, synthetic construct
  source 1..21: mol_type = other RNA; note = Description of Artificial Sequence: Synthetic oligonucleotide
tccagtgatggcaggaggatt

SEQ ID NO: 1724 - RNA, 21 nt, synthetic construct
  source 1..21: mol_type = other RNA; note = Description of Artificial Sequence: Synthetic oligonucleotide
tcagctgccctttggaataat

SEQ ID NO: 1725 - RNA, 21 nt, synthetic construct
  source 1..21: mol_type = other RNA; note = Description of Artificial Sequence: Synthetic oligonucleotide
ccctttggaataaagctgcct

SEQ ID NO: 1726 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atctcttggagtcctcacaggcc

SEQ ID NO: 1727 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
attctcttggagtcctcacaggc

SEQ ID NO: 1728 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
ataccctaggaaataccagagta

SEQ ID NO: 1729 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
accttgtaccctaggaaatacca

SEQ ID NO: 1730 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agcctgagtacacctggctgacc

SEQ ID NO: 1731 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcgggtaagatcctgggagaag

SEQ ID NO: 1732 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcggtttcactgcggaaggcac

SEQ ID NO: 1733 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aggctttggcggtttcactgcgg

SEQ ID NO: 1734 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agggctttggcggtttcactgcg

SEQ ID NO: 1735 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atgggctttggcggtttcactgc

SEQ ID NO: 1736 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
agcatcttctgggctttggcggt

SEQ ID NO: 1737 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
accttgagcatcttctgggcttt

SEQ ID NO: 1738 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
ataagttcccaggcgggtgctgg

SEQ ID NO: 1739 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agaatgaaccagaagaagcaggt

SEQ ID NO: 1740 - RNA, 23 nt, synthetic construct
  source 1..23: mol_type = other RNA; note = Description of Artificial Sequence: Synthetic oligonucleotide
atggagaatgaaccagaagaagc

SEQ ID NO: 1741 - RNA, 23 nt, synthetic construct
  source 1..23: mol_type = other RNA; note = Description of Artificial Sequence: Synthetic oligonucleotide
atttggagaatgaaccagaagaa

SEQ ID NO: 1742 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atgttgactgtggacagcagctc

SEQ ID NO: 1743 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagctgttgactgtggacagcag

SEQ ID NO: 1744 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acgagctgttgactgtggacagc

SEQ ID NO: 1745 - RNA, 23 nt, synthetic construct
  source 1..23: mol_type = other RNA; note = Description of Artificial Sequence: Synthetic oligonucleotide
attcacactggcttccaggatca

SEQ ID NO: 1746 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actttcacactggcttccaggat

SEQ ID NO: 1747 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
agtctttcacactggcttccagg

SEQ ID NO: 1748 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atgtctttcacactggcttccag

SEQ ID NO: 1749 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aatgtctttcacactggcttcca

SEQ ID NO: 1750 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
actatgtctttcacactggcttc

SEQ ID NO: 1751 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagctatgtctttcacactggct

SEQ ID NO: 1752 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcagctatgtctttcacactgg

SEQ ID NO: 1753 - RNA, 23 nt, synthetic construct
  source 1..23: mol_type = other RNA; note = Description of Artificial Sequence: Synthetic oligonucleotide
aaatgcagctatgtctttcacac

SEQ ID NO: 1754 - RNA, 23 nt, synthetic construct
  source 1..23: mol_type = other RNA; note = Description of Artificial Sequence: Synthetic oligonucleotide
ataacaacccagcgtggaattca

SEQ ID NO: 1755 - RNA, 23 nt, synthetic construct
  source 1..23: mol_type = other RNA; note = Description of Artificial Sequence: Synthetic oligonucleotide
agctgtagcggtaacaacccagc

SEQ ID NO: 1756 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagctgtagcggtaacaacccag

SEQ ID NO: 1757 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atccactccagccggagtttgag

SEQ ID NO: 1758 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aacgtcatacatggccagtcggt

SEQ ID NO: 1759 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaggtgatgagcctcttctccag

SEQ ID NO: 1760 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagctgtgcaggcccttcttcca

SEQ ID NO: 1761 - RNA, 23 nt, synthetic construct
  source 1..23: mol_type = other RNA; note = Description of Artificial Sequence: Synthetic oligonucleotide
agtagtagctgtgcaggcccttc

SEQ ID NO: 1762 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaaatcatacttctgcctcctca

SEQ ID NO: 1763 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
atgttctggatcgtccactggcc

SEQ ID NO: 1764 - RNA, 23 nt, synthetic construct
  source 1..23: mol_type = other RNA; note = Description of Artificial Sequence: Synthetic oligonucleotide
agtacaagccatagtgcacccgc

SEQ ID NO: 1765 - RNA, 23 nt, synthetic construct
  source 1..23: mol_type = other RNA; note = Description of Artificial Sequence: Synthetic oligonucleotide
atgtacaagccatagtgcacccg

SEQ ID NO: 1766 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aggttgtacaagccatagtgcac

SEQ ID NO: 1767 - RNA, 23 nt, synthetic construct
  source 1..23: mol_type = other RNA; note = Description of Artificial Sequence: Synthetic oligonucleotide
aagaggaactctccagggcaggg

SEQ ID NO: 1768 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
agtttctctcatccaggccgttg

SEQ ID NO: 1769 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcagtttctctcatccaggccg

SEQ ID NO: 1770 - RNA, 23 nt, synthetic construct
  source 1..23: mol_type = other RNA; note = Description of Artificial Sequence: Synthetic oligonucleotide
atctgcaaacgcagtttctctca

SEQ ID NO: 1771 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
agaatgtggctctgcaaacgcag

SEQ ID NO: 1772 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atgggcttcttcacgcagctccg

SEQ ID NO: 1773 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attatcacccagcggtcagcgat

SEQ ID NO: 1774 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acatgctgtcctcctggaagcag

SEQ ID NO: 1775 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aagttctgccacaccttgcccag

SEQ ID NO: 1776 - RNA, 23 nt, synthetic construct
  source 1..23: mol_type = other RNA; note = Description of Artificial Sequence: Synthetic oligonucleotide
agaaggacacctctccaggccag

SEQ ID NO: 1777 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atcaccttgaaggacacctctcc

SEQ ID NO: 1778 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acttcttgcccttgcggtagccg

SEQ ID NO: 1779 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
agggtgtagacgccgaagtagtt

SEQ ID NO: 1780 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atgtgatgcgggtgtagacgccg

SEQ ID NO: 1781 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actgtgatgcgggtgtagacgcc

SEQ ID NO: 1782 - RNA, 23 nt, synthetic construct
  source 1..23: mol_type = other RNA; note = Description of Artificial Sequence: Synthetic oligonucleotide
aatcacacctgtgatgcgggtgt

SEQ ID NO: 1783 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaggtcaccacttgctggatcca

SEQ ID NO: 1784 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atttattccaaagggcagctgag

SEQ ID NO: 1785 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agcagctttattccaaagggcag

SEQ ID NO: 1786 - RNA, 23 nt, synthetic construct
  source 1..23: mol_type = other RNA; note = Description of Artificial Sequence: Synthetic oligonucleotide
aaccagaagaagcaggtgagggg

SEQ ID NO: 1787 - RNA, 23 nt, synthetic construct
  source 1..23: mol_type = other RNA; note = Description of Artificial Sequence: Synthetic oligonucleotide
aaccagaagaagcaggtgaggct

SEQ ID NO: 1788 - RNA, 21 nt, synthetic construct
  source 1..21: mol_type = other RNA; note = Description of Artificial Sequence: Synthetic oligonucleotide
aaccagaagaagcaggtgagg

SEQ ID NO: 1789 - RNA, 21 nt, synthetic construct
  source 1..21: mol_type = other RNA; note = Description of Artificial Sequence: Synthetic oligonucleotide
aaccagaagaagcaggtgact

SEQ ID NO: 1790 - RNA, 19 nt, synthetic construct
  source 1..19: mol_type = other RNA; note = Description of Artificial Sequence: Synthetic oligonucleotide
aaccagaagaagcaggtga

SEQ ID NO: 1791 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agcttcctcgccatcacctccgt

SEQ ID NO: 1792 - RNA, 23 nt, synthetic construct
  source 1..23: mol_type = other RNA; note = Description of Artificial Sequence: Synthetic oligonucleotide
attggagtcctcacaggccttga

SEQ ID NO: 1793 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atcttggagtcctcacaggcctt

SEQ ID NO: 1794 - RNA, 23 nt, synthetic construct
  source 1..23: mol_type = other RNA; note = Description of Artificial Sequence: Synthetic oligonucleotide
atgtaccctaggaaataccagag

SEQ ID NO: 1795 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attgtaccctaggaaataccaga

SEQ ID NO: 1796 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aacctccgccttgtaccctagga

SEQ ID NO: 1797 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agagtacacctggctgaccatca

SEQ ID NO: 1798 - RNA, 23 nt, synthetic construct
  source 1..23: mol_type = other RNA; note = Description of Artificial Sequence: Synthetic oligonucleotide
acctgagtacacctggctgacca

SEQ ID NO: 1799 - RNA, 23 nt, synthetic construct
  source 1..23: mol_type = other RNA; note = Description of Artificial Sequence: Synthetic oligonucleotide
atgcctgagtacacctggctgac

SEQ ID NO: 1800 - RNA, 23 nt, synthetic construct
  source 1..23: mol_type = other RNA; note = Description of Artificial Sequence: Synthetic oligonucleotide
atgggagaagtggcgattgagta

SEQ ID NO: 1801 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aagatcctgggagaagtggcgat

SEQ ID NO: 1802 - RNA, 23 nt, synthetic construct
  source 1..23: mol_type = other RNA; note = Description of Artificial Sequence: Synthetic oligonucleotide
atttcactgcggaaggcactaga

SEQ ID NO: 1803 - RNA, 23 nt, synthetic construct
  source 1..23: mol_type = other RNA; note = Description of Artificial Sequence: Synthetic oligonucleotide
atggcggtttcactgcggaaggc

SEQ ID NO: 1804 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actttggcggtttcactgcggaa

SEQ ID NO: 1805 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agctttggcggtttcactgcgga

SEQ ID NO: 1806 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagttcccaggcgggtgctggt

SEQ ID NO: 1807 - RNA, 23 nt, synthetic construct
  source 1..23: mol_type = other RNA; note = Description of Artificial Sequence: Synthetic oligonucleotide
atgaaccagaagaagcaggtgag

SEQ ID NO: 1808 - RNA, 23 nt, synthetic construct
  source 1..23: mol_type = other RNA; note = Description of Artificial Sequence: Synthetic oligonucleotide
attggagaatgaaccagaagaag

SEQ ID NO: 1809 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aatttggagaatgaaccagaaga

SEQ ID NO: 1810 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agatttggagaatgaaccagaag

SEQ ID NO: 1811 - RNA, 23 nt, synthetic construct
  source 1..23: mol_type = other RNA; note = Description of Artificial Sequence: Synthetic oligonucleotide
agtggacagcagctcctccacca

SEQ ID NO: 1812 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
acacttcgtactcggccctgtag

SEQ ID NO: 1813 - RNA, 23 nt, synthetic construct
  source 1..23: mol_type = other RNA; note = Description of Artificial Sequence: Synthetic oligonucleotide
agtccacttcgtactcggccctg

SEQ ID NO: 1814 - RNA, 23 nt, synthetic construct
  source 1..23: mol_type = other RNA; note = Description of Artificial Sequence: Synthetic oligonucleotide
atttcacactggcttccaggatc

SEQ ID NO: 1815 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atctttcacactggcttccagga

SEQ ID NO: 1816 - RNA, 23 nt, synthetic construct
  source 1..23: mol_type = other RNA; note = Description of Artificial Sequence: Synthetic oligonucleotide
atatgtctttcacactggcttcc

SEQ ID NO: 1817 - RNA, 23 nt, synthetic construct
  source 1..23: mol_type = other RNA; note = Description of Artificial Sequence: Synthetic oligonucleotide
agctatgtctttcacactggctt

SEQ ID NO: 1818 - RNA, 23 nt, synthetic construct
  source 1..23: mol_type = other RNA; note = Description of Artificial Sequence: Synthetic oligonucleotide
atagcggtaacaacccagcgtgg

SEQ ID NO: 1819 - RNA, 23 nt, synthetic construct
  source 1..23: mol_type = other RNA; note = Description of Artificial Sequence: Synthetic oligonucleotide
atgtagcggtaacaacccagcgt

SEQ ID NO: 1820 - RNA, 23 nt, synthetic construct
  source 1..23: mol_type = other RNA; note = Description of Artificial Sequence: Synthetic oligonucleotide
agtgatgagcctcttctccaggg

SEQ ID NO: 1821 - RNA, 23 nt, synthetic construct
  source 1..23: mol_type = other RNA; note = Description of Artificial Sequence: Synthetic oligonucleotide
atacaccgaggtgatgagcctct

SEQ ID NO: 1822 - RNA, 23 nt, synthetic construct
  source 1..23: mol_type = other RNA; note = Description of Artificial Sequence: Synthetic oligonucleotide
atagctgtgcaggcccttcttcc

SEQ ID NO: 1823 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atagtagctgtgcaggcccttct

SEQ ID NO: 1824 - RNA, 23 nt, synthetic construct
  source 1..23: mol_type = other RNA; note = Description of Artificial Sequence: Synthetic oligonucleotide
acaagccgtagtccagagagggc

SEQ ID NO: 1825 - RNA, 23 nt, synthetic construct
  source 1..23: mol_type = other RNA; note = Description of Artificial Sequence: Synthetic oligonucleotide
agcacggcaaatcatacttctgc

SEQ ID NO: 1826 - RNA, 23 nt, synthetic construct
  source 1..23: mol_type = other RNA; note = Description of Artificial Sequence: Synthetic oligonucleotide
atgcacggcaaatcatacttctg

SEQ ID NO: 1827 - RNA, 23 nt, synthetic construct
  source 1..23: mol_type = other RNA; note = Description of Artificial Sequence: Synthetic oligonucleotide
agtgcacggcaaatcatacttct

SEQ ID NO: 1828 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agggtgcacggcaaatcatactt

SEQ ID NO: 1829 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attctggatcgtccactggccct

SEQ ID NO: 1830 - RNA, 23 nt, synthetic construct
  source 1..23: mol_type = other RNA; note = Description of Artificial Sequence: Synthetic oligonucleotide
atgagggagatctgggaggtgaa

SEQ ID NO: 1831 - RNA, 23 nt, synthetic construct
  source 1..23: mol_type = other RNA; note = Description of Artificial Sequence: Synthetic oligonucleotide
acaagccatagtgcacccgcaca

SEQ ID NO: 1832 - RNA, 23 nt, synthetic construct
  source 1..23: mol_type = other RNA; note = Description of Artificial Sequence: Synthetic oligonucleotide
atacaagccatagtgcacccgca

SEQ ID NO: 1833 - RNA, 23 nt, synthetic construct
  source 1..23: mol_type = other RNA; note = Description of Artificial Sequence: Synthetic oligonucleotide
atttctctcatccaggccgttgg

SEQ ID NO: 1834 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aagtttctctcatccaggccgtt

SEQ ID NO: 1835 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
actctgcaaacgcagtttctctc

SEQ ID NO: 1836 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aatgtggctctgcaaacgcagtt

SEQ ID NO: 1837 - RNA, 23 nt, synthetic construct
  source 1..23: mol_type = other RNA; note = Description of Artificial Sequence: Synthetic oligonucleotide
aaatgtggctctgcaaacgcagt

SEQ ID NO: 1838 - RNA, 23 nt, synthetic construct
  source 1..23: mol_type = other RNA; note = Description of Artificial Sequence: Synthetic oligonucleotide
aggaatgtggctctgcaaacgca

SEQ ID NO: 1839 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
acactggaaggtgaatgtcccac

SEQ ID NO: 1840 - RNA, 23 nt, synthetic construct
  source 1..23: mol_type = other RNA; note = Description of Artificial Sequence: Synthetic oligonucleotide
atcacactggaaggtgaatgtcc

SEQ ID NO: 1841 - RNA, 23 nt, synthetic construct
  source 1..23: mol_type = other RNA; note = Description of Artificial Sequence: Synthetic oligonucleotide
attgggcttcttcacgcagctcc

SEQ ID NO: 1842 - RNA, 23 nt, synthetic construct
  source 1..23: mol_type = other RNA; note = Description of Artificial Sequence: Synthetic oligonucleotide
agttgggcttcttcacgcagctc

SEQ ID NO: 1843 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aggttgggcttcttcacgcagct

SEQ ID NO: 1844 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agggttgggcttcttcacgcagc

SEQ ID NO: 1845 - RNA, 23 nt, synthetic construct
  source 1..23: mol_type = other RNA; note = Description of Artificial Sequence: Synthetic oligonucleotide
agaggccacagtcacagtgctcc

SEQ ID NO: 1846 - RNA, 23 nt, synthetic construct
  source 1..23: mol_type = other RNA; note = Description of Artificial Sequence: Synthetic oligonucleotide
atatcacccagcggtcagcgatg

SEQ ID NO: 1847 - RNA, 23 nt, synthetic construct
  source 1..23: mol_type = other RNA; note = Description of Artificial Sequence: Synthetic oligonucleotide
aatgctgtcctcctggaagcagt

SEQ ID NO: 1848 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
accatgctgtcctcctggaagca

SEQ ID NO: 1849 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attctgccacaccttgcccagga

SEQ ID NO: 1850 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agagttctgccacaccttgccca

SEQ ID NO: 1851 - RNA, 23 nt, synthetic construct
  source 1..23: mol_type = other RNA; note = Description of Artificial Sequence: Synthetic oligonucleotide
atgaaggacacctctccaggcca

SEQ ID NO: 1852 - RNA, 23 nt, synthetic construct
  source 1..23: mol_type = other RNA; note = Description of Artificial Sequence: Synthetic oligonucleotide
attgaaggacacctctccaggcc

SEQ ID NO: 1853 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
acgctgcacaggtcctgtgggat

SEQ ID NO: 1854 - RNA, 23 nt, synthetic construct
  source 1..23: mol_type = other RNA; note = Description of Artificial Sequence: Synthetic oligonucleotide
atcgctgcacaggtcctgtggga

SEQ ID NO: 1855 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
agcatgcgtggcgtcacctggta

SEQ ID NO: 1856 - RNA, 23 nt, synthetic construct
  source 1..23: mol_type = other RNA; note = Description of Artificial Sequence: Synthetic oligonucleotide
agcacacagcatgcgtggcgtca

SEQ ID NO: 1857 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attcttgcccttgcggtagccgg

SEQ ID NO: 1858 - RNA, 23 nt, synthetic construct
  source 1..23: mol_type = other RNA; note = Description of Artificial Sequence: Synthetic oligonucleotide
aggccactgagtgccttgcacac

SEQ ID NO: 1859 - RNA, 23 nt, synthetic construct
  source 1..23: mol_type = other RNA; note = Description of Artificial Sequence: Synthetic oligonucleotide
agtcaccacttgctggatccagc

SEQ ID NO: 1860 - RNA, 23 nt, synthetic construct
  source 1..23: mol_type = other RNA; note = Description of Artificial Sequence: Synthetic oligonucleotide
acaggtcaccacttgctggatcc

SEQ ID NO: 1861 - RNA, 23 nt, synthetic construct
  source 1..23: mol_type = other RNA; note = Description of Artificial Sequence: Synthetic oligonucleotide
attcctcaggtcaccacttgctg

SEQ ID NO: 1862 - RNA, 23 nt, synthetic construct
  source 1..23: mol_type = other RNA; note = Description of Artificial Sequence: Synthetic oligonucleotide
agatgccacctcctgccaccaca

SEQ ID NO: 1863 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aagatgccacctcctgccaccac

SEQ ID NO: 1864 - RNA, 23 nt, synthetic construct
  source 1..23: mol_type = other RNA; note = Description of Artificial Sequence: Synthetic oligonucleotide
aatcctcctgccatcactggagc

SEQ ID NO: 1865 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atattccaaagggcagctgagct

SEQ ID NO: 1866 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attattccaaagggcagctgagc

SEQ ID NO: 1867 - RNA, 23 nt, synthetic construct
  source 1..23: mol_type = other RNA; note = Description of Artificial Sequence: Synthetic oligonucleotide
aggcagctttattccaaagggca

SEQ ID NO: 1868 - RNA, 23 nt, synthetic construct
  source 1..23: mol_type = other RNA; note = Description of Artificial Sequence: Synthetic oligonucleotide
aaggcagctttattccaaagggc

SEQ ID NO: 1869 - RNA, 23 nt, synthetic construct
  source 1..23: mol_type = other RNA; note = Description of Artificial Sequence: Synthetic oligonucleotide
atcaggcagctttattccaaagg

SEQ ID NO: 1870 - RNA, 23 nt, synthetic construct
  source 1..23: mol_type = other RNA; note = Description of Artificial Sequence: Synthetic oligonucleotide
aatcaggcagctttattccaaag

SEQ ID NO: 1871 - RNA, 23 nt, synthetic construct
  source 1..23: mol_type = other RNA; note = Description of Artificial Sequence: Synthetic oligonucleotide
agatcaggcagctttattccaaa

SEQ ID NO: 1872 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cggaggtgatggcgaggaagt

SEQ ID NO: 1873 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctgtgaggactccaagagat

SEQ ID NO: 1874 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgtgaggactccaagagaat

SEQ ID NO: 1875 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctctggtatttcctagggtat

SEQ ID NO: 1876 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtatttcctagggtacaagt

SEQ ID NO: 1877 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtatttcctagggtacaaggt

SEQ ID NO: 1878 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtcagccaggtgtactcagt

SEQ ID NO: 1879 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcagccaggtgtactcaggct

SEQ ID NO: 1880 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agccaggtgtactcaggcagt

SEQ ID NO: 1881 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cacttctcccaggatcttact

SEQ ID NO: 1882 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctcccaggatcttacccgct

SEQ ID NO: 1883 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccttccgcagtgaaaccgct

SEQ ID NO: 1884 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccttccgcagtgaaaccgcct

SEQ ID NO: 1885 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcagtgaaaccgccaaagcct

SEQ ID NO: 1886 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagtgaaaccgccaaagccct

SEQ ID NO: 1887 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agtgaaaccgccaaagcccat

SEQ ID NO: 1888 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgccaaagcccagaagatgct

SEQ ID NO: 1889 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agcccagaagatgctcaaggt

SEQ ID NO: 1890 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agcacccgcctgggaacttat

SEQ ID NO: 1891 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caactccagctccgtctattt

SEQ ID NO: 1892 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcacctgcttcttctggttct

SEQ ID NO: 1893 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctgcttcttctggttcattt

SEQ ID NO: 1894 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgcttcttctggttcattct

SEQ ID NO: 1895 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cttcttctggttcattctcct

SEQ ID NO: 1896 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttcttctggttcattctccat

SEQ ID NO: 1897 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cttctggttcattctccaaat

SEQ ID NO: 1898 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggttcattctccaaatcct

SEQ ID NO: 1899 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgctgtccacagtcaacat

SEQ ID NO: 1900 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgtccacagtcaacagctt

SEQ ID NO: 1901 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgtccacagtcaacagctcgt

SEQ ID NO: 1902 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggccgagtacgaagtggacct

SEQ ID NO: 1903 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atcctggaagccagtgtgaat

SEQ ID NO: 1904 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctggaagccagtgtgaaagt

SEQ ID NO: 1905 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggaagccagtgtgaaagact

SEQ ID NO: 1906 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggaagccagtgtgaaagacat

SEQ ID NO: 1907 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaagccagtgtgaaagacatt

SEQ ID NO: 1908 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agccagtgtgaaagacatagt

SEQ ID NO: 1909 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagtgtgaaagacatagctt

SEQ ID NO: 1910 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agtgtgaaagacatagctgct

SEQ ID NO: 1911 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgaaagacatagctgcattt

SEQ ID NO: 1912 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
attgaattccacgctgggttt

SEQ ID NO: 1913 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aattccacgctgggttgttat

SEQ ID NO: 1914 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cacgctgggttgttaccgctt

SEQ ID NO: 1915 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgggttgttaccgctacagct

SEQ ID NO: 1916 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggttgttaccgctacagctt

SEQ ID NO: 1917 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caaactccggctggagtggat

SEQ ID NO: 1918 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggaccgactggccatgtatt

SEQ ID NO: 1919 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgactggccatgtatgacgtt

SEQ ID NO: 1920 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggagaagaggctcatcacct

SEQ ID NO: 1921 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggagaagaggctcatcacctt

SEQ ID NO: 1922 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaagaagggcctgcacagctt

SEQ ID NO: 1923 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agggcctgcacagctactact

SEQ ID NO: 1924 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctgcacagctactacgacct

SEQ ID NO: 1925 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaggaggcagaagtatgattt

SEQ ID NO: 1926 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aggaggcagaagtatgatttt

SEQ ID NO: 1927 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agtatgatttgccgtgcacct

SEQ ID NO: 1928 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagtggacgatccagaacat

SEQ ID NO: 1929 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagaacaggaggctgtgtgt

SEQ ID NO: 1930 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaacaggaggctgtgtggct

SEQ ID NO: 1931 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acttcacctcccagatctcct

SEQ ID NO: 1932 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgtgcgggtgcactatggctt

SEQ ID NO: 1933 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgcgggtgcactatggcttt

SEQ ID NO: 1934 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggtgcactatggcttgtact

SEQ ID NO: 1935 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtgcactatggcttgtacat

SEQ ID NO: 1936 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcactatggcttgtacaact

SEQ ID NO: 1937 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcactatggcttgtacaacct

SEQ ID NO: 1938 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgccctggagagttcctctt

SEQ ID NO: 1939 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acggcctggatgagagaaact

SEQ ID NO: 1940 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctggatgagagaaactgct

SEQ ID NO: 1941 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctggatgagagaaactgcgt

SEQ ID NO: 1942 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agagaaactgcgtttgcagat

SEQ ID NO: 1943 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcgtttgcagagccacattct

SEQ ID NO: 1944 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgggacattcaccttccagtt

SEQ ID NO: 1945 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagctgcgtgaagaagcccat

SEQ ID NO: 1946 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgctgaccgctgggtgataat

SEQ ID NO: 1947 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcttccaggaggacagcatgt

SEQ ID NO: 1948 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgtgttcctgggcaaggtgtt

SEQ ID NO: 1949 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggcaaggtgtggcagaactt

SEQ ID NO: 1950 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcaaggtgtggcagaactcgt

SEQ ID NO: 1951 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
caaggtgtggcagaactcgct

SEQ ID NO: 1952 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcctggagaggtgtccttct

SEQ ID NO: 1953 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggagaggtgtccttcaagt

SEQ ID NO: 1954 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaggtgtccttcaaggtgat

SEQ ID NO: 1955 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctaccgcaagggcaagaagt

SEQ ID NO: 1956 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctaccgcaagggcaagaaggt

SEQ ID NO: 1957 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
actacttcggcgtctacacct

SEQ ID NO: 1958 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctacttcggcgtctacaccct

SEQ ID NO: 1959 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcgtctacacccgcatcacat

SEQ ID NO: 1960 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgtctacacccgcatcacagt

SEQ ID NO: 1961 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acccgcatcacaggtgtgatt

SEQ ID NO: 1962 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gatccagcaagtggtgacctt

SEQ ID NO: 1963 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcaggaggtggcatcttgtt

SEQ ID NO: 1964 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tccctgatgtctgctccagtt

SEQ ID NO: 1965 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgatgtctgctccagtgatt

SEQ ID NO: 1966 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggctcagcagcaagaatgctt

SEQ ID NO: 1967 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttgggatctgggaatggaagt

SEQ ID NO: 1968 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagctgccctttggaataaat

SEQ ID NO: 1969 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgccctttggaataaagctt

SEQ ID NO: 1970 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccctttggaataaagctgct

SEQ ID NO: 1971 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctcacctgcttcttctggtt

SEQ ID NO: 1972 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-fluorocytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcacctgcttcttctggtt

SEQ ID NO: 1973 - RNA, 17 nt, synthetic construct
  source 1..17: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-fluorocytidine-3'-phosphate
  modified_base 4: mod_base = OTHER; note = 2'-O-methyluridine-3'-phosphate
  modified_base 5: mod_base = OTHER; note = 2'-fluoroguanosine-3'-phosphate
  modified_base 6: mod_base = OTHER; note = 2'-fluorocytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acctgcttcttctggtt

SEQ ID NO: 1974 - RNA, 19 nt, synthetic construct
  source 1..19: mol_type = other RNA; note = Description of Artificial Sequence: Synthetic oligonucleotide
  modified_base 1: mod_base = OTHER; note = 2'-fluorouridine-3'-phosphate
  modified_base 2: mod_base = OTHER; note = 2'-O-methylcytidine-3'-phosphate
  modified_base 3: mod_base = OTHER; note = 2'-fluoroadenosine-3'-phosphate
  modified_base 4: mod_base = OTHER; note = 2'-O-methylcytidine-3'-phosphate
  modified_base 5: mod_base = OTHER; note = 2'-fluorocytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-fluorouridine-3'-phosphate
  modified_base 14: mod_base = OTHER; note = 2'-O-methylcytidine-3'-phosphate
  modified_base 15: mod_base = OTHER; note = 2'-fluorouridine-3'-phosphate
  modified_base 16: mod_base = OTHER; note = 2'-O-methylguanosine-3'-phosphate
  modified_base 17: mod_base = OTHER; note = 2'-fluoroguanosine-3'-phosphorothioate
  modified_base 18: mod_base = OTHER; note = 2'-O-methyluridine-3'-phosphorothioate
  modified_base 19: mod_base = OTHER; note = 2'-fluorouridine-3'-phosphate
tcacctgcttcttctggtt

SEQ ID NO: 1975 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggaggtgatggcgaggaagct

SEQ ID NO: 1976 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aaggcctgtgaggactccaat

SEQ ID NO: 1977 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcctgtgaggactccaagat

SEQ ID NO: 1978 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctgtgaggactccaagagt

SEQ ID NO: 1979 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctactctggtatttcctaggt

SEQ ID NO: 1980 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctggtatttcctagggtact

SEQ ID NO: 1981 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggtatttcctagggtacat

SEQ ID NO: 1982 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggtatttcctagggtacaat

SEQ ID NO: 1983 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctagggtacaaggcggaggtt

SEQ ID NO: 1984 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atggtcagccaggtgtactct

SEQ ID NO: 1985 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtcagccaggtgtactcaggt

SEQ ID NO: 1986 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagccaggtgtactcaggcat

SEQ ID NO: 1987 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctcaatcgccacttctcccat

SEQ ID NO: 1988 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgccacttctcccaggatctt

SEQ ID NO: 1989 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccacttctcccaggatcttt

SEQ ID NO: 1990 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcccaggatcttacccgccgt

SEQ ID NO: 1991 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tagtgccttccgcagtgaaat

SEQ ID NO: 1992 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cttccgcagtgaaaccgccat

SEQ ID NO: 1993 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccgcagtgaaaccgccaaagt

SEQ ID NO: 1994 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgcagtgaaaccgccaaagct

SEQ ID NO: 1995 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccaaagcccagaagatgctt

SEQ ID NO: 1996 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagcacccgcctgggaacttt

SEQ ID NO: 1997 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acaactccagctccgtctatt

SEQ ID NO: 1998 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cacctgcttcttctggttcat

SEQ ID NO: 1999 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcttcttctggttcattctt

SEQ ID NO: 2000 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcttctggttcattctccaat

SEQ ID NO: 2001 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttctggttcattctccaaatt

SEQ ID NO: 2002 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctggttcattctccaaatct

SEQ ID NO: 2003 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtggaggagctgctgtccact

SEQ ID NO: 2004 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaggagctgctgtccacagtt

SEQ ID NO: 2005 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agctgctgtccacagtcaact

SEQ ID NO: 2006 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgtccacagtcaacagctct

SEQ ID NO: 2007 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acagggccgagtacgaagtgt

SEQ ID NO: 2008 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggccgagtacgaagtggact

SEQ ID NO: 2009 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcctggaagccagtgtgaaat

SEQ ID NO: 2010 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggaagccagtgtgaaagat

SEQ ID NO: 2011 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aagccagtgtgaaagacatat

SEQ ID NO: 2012 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccagtgtgaaagacatagct

SEQ ID NO: 2013 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgtgaaagacatagctgcatt

SEQ ID NO: 2014 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acgctgggttgttaccgctat

SEQ ID NO: 2015 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgctgggttgttaccgctact

SEQ ID NO: 2016 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgggttgttaccgctacat

SEQ ID NO: 2017 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgggttgttaccgctacagt

SEQ ID NO: 2018 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctggagaagaggctcatcact

SEQ ID NO: 2019 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagaagaggctcatcacctct

SEQ ID NO: 2020 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaagaggctcatcacctcggt

SEQ ID NO: 2021 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aggctcatcacctcggtgtat

SEQ ID NO: 2022 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aagaagggcctgcacagctat

SEQ ID NO: 2023 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aagggcctgcacagctactat

SEQ ID NO: 2024 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctctctggactacggcttgt

SEQ ID NO: 2025 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tctctggactacggcttggct

SEQ ID NO: 2026 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggactacggcttggccctct

SEQ ID NO: 2027 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggactacggcttggccctctt

SEQ ID NO: 2028 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agaagtatgatttgccgtgct

SEQ ID NO: 2029 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gaagtatgatttgccgtgcat

SEQ ID NO: 2030 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aagtatgatttgccgtgcact

SEQ ID NO: 2031 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtatgatttgccgtgcaccct

SEQ ID NO: 2032 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggccagtggacgatccagaat

SEQ ID NO: 2033 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gccagtggacgatccagaact

SEQ ID NO: 2034 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggacgatccagaacaggagt

SEQ ID NO: 2035 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cacctcccagatctccctcat

SEQ ID NO: 2036 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcgggtgcactatggcttgt

SEQ ID NO: 2037 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcgggtgcactatggcttgtt

SEQ ID NO: 2038 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgggtgcactatggcttgtat

SEQ ID NO: 2039 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
aacggcctggatgagagaaat

SEQ ID NO: 2040 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cggcctggatgagagaaactt

SEQ ID NO: 2041 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gagaaactgcgtttgcagagt

SEQ ID NO: 2042 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgcgtttgcagagccacatt

SEQ ID NO: 2043 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcgtttgcagagccacattt

SEQ ID NO: 2044 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cgtttgcagagccacattcct

SEQ ID NO: 2045 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcagagccacattccagtgct

SEQ ID NO: 2046 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gggacattcaccttccagtgt

SEQ ID NO: 2047 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggacattcaccttccagtgtt

SEQ ID NO: 2048 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acattcaccttccagtgtgat

SEQ ID NO: 2049 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agctgcgtgaagaagcccaat

SEQ ID NO: 2050 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgcgtgaagaagcccaact

SEQ ID NO: 2051 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgcgtgaagaagcccaacct

SEQ ID NO: 2052 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcgtgaagaagcccaaccct

SEQ ID NO: 2053 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
agcactgtgactgtggcctct

SEQ ID NO: 2054 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctccgagggtgagtggccatt

SEQ ID NO: 2055 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atcgctgaccgctgggtgatt

SEQ ID NO: 2056 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcgctgaccgctgggtgatat

SEQ ID NO: 2057 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgaccgctgggtgataact

SEQ ID NO: 2058 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gctgggtgataacagctgcct

SEQ ID NO: 2059 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcttccaggaggacagcatt

SEQ ID NO: 2060 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cttccaggaggacagcatggt

SEQ ID NO: 2061 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctgggcaaggtgtggcagaat

SEQ ID NO: 2062 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgggcaaggtgtggcagaact

SEQ ID NO: 2063 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggcaaggtgtggcagaactct

SEQ ID NO: 2064 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggcctggagaggtgtccttt

SEQ ID NO: 2065 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcctggagaggtgtccttcat

SEQ ID NO: 2066 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctggagaggtgtccttcaat

SEQ ID NO: 2067 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgtgcagttgatcccacaggt

SEQ ID NO: 2068 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgcagttgatcccacaggact

SEQ ID NO: 2069 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atcccacaggacctgtgcagt

SEQ ID NO: 2070 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cccacaggacctgtgcagcgt

SEQ ID NO: 2071 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccacaggacctgtgcagcgat

SEQ ID NO: 2072 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccaggtgacgccacgcatgct

SEQ ID NO: 2073 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgacgccacgcatgctgtgt

SEQ ID NO: 2074 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tgacgccacgcatgctgtgtt

SEQ ID NO: 2075 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
acgccacgcatgctgtgtgct

SEQ ID NO: 2076 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggctaccgcaagggcaagaat

SEQ ID NO: 2077 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgcaaggcactcagtggcct

SEQ ID NO: 2078 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctaactacttcggcgtctact

SEQ ID NO: 2079 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctacacccgcatcacaggtgt

SEQ ID NO: 2080 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cccgcatcacaggtgtgatct

SEQ ID NO: 2081 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggatccagcaagtggtgact

SEQ ID NO: 2082 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
atccagcaagtggtgacctgt

SEQ ID NO: 2083 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccagcaagtggtgacctgagt

SEQ ID NO: 2084 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cagcaagtggtgacctgaggt

SEQ ID NO: 2085 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gcaagtggtgacctgaggaat

SEQ ID NO: 2086 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggtggcaggaggtggcatct

SEQ ID NO: 2087 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ggtggcaggaggtggcatctt

SEQ ID NO: 2088 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtggcaggaggtggcatcttt

SEQ ID NO: 2089 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tccagtgatggcaggaggatt

SEQ ID NO: 2090 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctaacttgggatctgggaatt

SEQ ID NO: 2091 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gtgagctcagctgccctttgt

SEQ ID NO: 2092 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ctcagctgccctttggaatat

SEQ ID NO: 2093 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tcagctgccctttggaataat

SEQ ID NO: 2094 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ccctttggaataaagctgcct

SEQ ID NO: 2095 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate
cctttggaataaagctgcctt

SEQ ID NO: 2096 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tttggaataaagctgcctgat

SEQ ID NO: 2097 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
ttggaataaagctgcctgatt

SEQ ID NO: 2098 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
tggaataaagctgcctgatct

SEQ ID NO: 2099 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acttcctcgccatcacctccgtc

SEQ ID NO: 2100 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atctcttggagtcctcacaggcc

SEQ ID NO: 2101 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
attctcttggagtcctcacaggc

SEQ ID NO: 2102 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
ataccctaggaaataccagagta

SEQ ID NO: 2103 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
acttgtaccctaggaaataccag

SEQ ID NO: 2104 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
accttgtaccctaggaaatacca

SEQ ID NO: 2105 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
actgagtacacctggctgaccat

SEQ ID NO: 2106 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agcctgagtacacctggctgacc

SEQ ID NO: 2107 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
actgcctgagtacacctggctga

SEQ ID NO: 2108 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtaagatcctgggagaagtggc

SEQ ID NO: 2109 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcgggtaagatcctgggagaag

SEQ ID NO: 2110 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcggtttcactgcggaaggcac

SEQ ID NO: 2111 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggcggtttcactgcggaaggca

SEQ ID NO: 2112 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggctttggcggtttcactgcgg

SEQ ID NO: 2113 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agggctttggcggtttcactgcg

SEQ ID NO: 2114 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgggctttggcggtttcactgc

SEQ ID NO: 2115 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcatcttctgggctttggcggt

SEQ ID NO: 2116 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
accttgagcatcttctgggcttt

SEQ ID NO: 2117 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
ataagttcccaggcgggtgctgg

SEQ ID NO: 2118 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaatagacggagctggagttgta

SEQ ID NO: 2119 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agaaccagaagaagcaggtgagg

SEQ ID NO: 2120 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aaatgaaccagaagaagcaggtg

SEQ ID NO: 2121 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agaatgaaccagaagaagcaggt

SEQ ID NO: 2122 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aggagaatgaaccagaagaagca

SEQ ID NO: 2123 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atggagaatgaaccagaagaagc

SEQ ID NO: 2124 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atttggagaatgaaccagaagaa

SEQ ID NO: 2125 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggatttggagaatgaaccagaa

SEQ ID NO: 2126 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgttgactgtggacagcagctc

SEQ ID NO: 2127 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctgttgactgtggacagcag

SEQ ID NO: 2128 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acgagctgttgactgtggacagc

SEQ ID NO: 2129 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aggtccacttcgtactcggccct

SEQ ID NO: 2130 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
attcacactggcttccaggatca

SEQ ID NO: 2131 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
actttcacactggcttccaggat

SEQ ID NO: 2132 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtctttcacactggcttccagg

SEQ ID NO: 2133 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgtctttcacactggcttccag

SEQ ID NO: 2134 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatgtctttcacactggcttcca

SEQ ID NO: 2135 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
actatgtctttcacactggcttc

SEQ ID NO: 2136 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctatgtctttcacactggct

SEQ ID NO: 2137 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcagctatgtctttcacactgg

SEQ ID NO: 2138 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaatgcagctatgtctttcacac

SEQ ID NO: 2139 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaacccagcgtggaattcaatgc

SEQ ID NO: 2140 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
ataacaacccagcgtggaattca

SEQ ID NO: 2141 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagcggtaacaacccagcgtgga

SEQ ID NO: 2142 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agctgtagcggtaacaacccagc

SEQ ID NO: 2143 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctgtagcggtaacaacccag

SEQ ID NO: 2144 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atccactccagccggagtttgag

SEQ ID NO: 2145 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatacatggccagtcggtcccgg

SEQ ID NO: 2146 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aacgtcatacatggccagtcggt

SEQ ID NO: 2147 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtgatgagcctcttctccagg

SEQ ID NO: 2148 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aaggtgatgagcctcttctccag

SEQ ID NO: 2149 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctgtgcaggcccttcttcca

SEQ ID NO: 2150 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtagtagctgtgcaggcccttc

SEQ ID NO: 2151 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggtcgtagtagctgtgcaggcc

SEQ ID NO: 2152 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaatcatacttctgcctcctcag

SEQ ID NO: 2153 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaaatcatacttctgcctcctca

SEQ ID NO: 2154 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aggtgcacggcaaatcatacttc

SEQ ID NO: 2155 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgttctggatcgtccactggcc

SEQ ID NO: 2156 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acacacagcctcctgttctggat

SEQ ID NO: 2157 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agccacacagcctcctgttctgg

SEQ ID NO: 2158 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggagatctgggaggtgaagttg

SEQ ID NO: 2159 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagccatagtgcacccgcacacc

SEQ ID NO: 2160 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaagccatagtgcacccgcacac

SEQ ID NO: 2161 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtacaagccatagtgcacccgc

SEQ ID NO: 2162 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atgtacaagccatagtgcacccg

SEQ ID NO: 2163 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agttgtacaagccatagtgcacc

SEQ ID NO: 2164 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aggttgtacaagccatagtgcac

SEQ ID NO: 2165 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aagaggaactctccagggcaggg

SEQ ID NO: 2166 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agtttctctcatccaggccgttg

SEQ ID NO: 2167 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcagtttctctcatccaggccg

SEQ ID NO: 2168 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acgcagtttctctcatccaggcc

SEQ ID NO: 2169 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atctgcaaacgcagtttctctca

SEQ ID NO: 2170 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agaatgtggctctgcaaacgcag

SEQ ID NO: 2171 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aactggaaggtgaatgtcccaca

SEQ ID NO: 2172 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgggcttcttcacgcagctccg

SEQ ID NO: 2173 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
attatcacccagcggtcagcgat

SEQ ID NO: 2174 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acatgctgtcctcctggaagcag

SEQ ID NO: 2175 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aacaccttgcccaggaacacggt

SEQ ID NO: 2176 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagttctgccacaccttgcccag

SEQ ID NO: 2177 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acgagttctgccacaccttgccc

SEQ ID NO: 2178 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcgagttctgccacaccttgcc

SEQ ID NO: 2179 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agaaggacacctctccaggccag

SEQ ID NO: 2180 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acttgaaggacacctctccaggc

SEQ ID NO: 2181 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atcaccttgaaggacacctctcc

SEQ ID NO: 2182 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
acttcttgcccttgcggtagccg

SEQ ID NO: 2183 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
accttcttgcccttgcggtagcc

SEQ ID NO: 2184 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aggtgtagacgccgaagtagtta

SEQ ID NO: 2185 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agggtgtagacgccgaagtagtt

SEQ ID NO: 2186 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atgtgatgcgggtgtagacgccg

SEQ ID NO: 2187 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
actgtgatgcgggtgtagacgcc

SEQ ID NO: 2188 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aatcacacctgtgatgcgggtgt

SEQ ID NO: 2189 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaggtcaccacttgctggatcca

SEQ ID NO: 2190 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aacaagatgccacctcctgccac

SEQ ID NO: 2191 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aactggagcagacatcagggacg

SEQ ID NO: 2192 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatcactggagcagacatcaggg

SEQ ID NO: 2193 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagcattcttgctgctgagccac

SEQ ID NO: 2194 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acttccattcccagatcccaagt

SEQ ID NO: 2195 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
atttattccaaagggcagctgag

SEQ ID NO: 2196 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagctttattccaaagggcagct

SEQ ID NO: 2197 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agcagctttattccaaagggcag

SEQ ID NO: 2198 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
aaccagaagaagcaggtgagggg

SEQ ID NO: 2199 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
aaccagaagaagcaggtgaggct

SEQ ID NO: 2200 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methylguanosine-3'-phosphate
aaccagaagaagcaggtgagg

SEQ ID NO: 2201 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
aaccagaagaagcaggtgact

SEQ ID NO: 2202 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphorothioate
  modified_base 18: mod_base = OTHER; note = 2'-O-methylguanosine-3'-phosphorothioate
  modified_base 19: mod_base = OTHER; note = 2'-O-methyladenosine-3'-phosphate
aaccagaagaagcaggtga

SEQ ID NO: 2203 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-fluorocytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-fluoroadenosine-3'-phosphate
  modified_base 9: mod_base = OTHER; note = 2'-O-methylguanosine-3'-phosphate
  modified_base 10: mod_base = OTHER; note = 2'-fluoroadenosine-3'-phosphate
  modified_base 11: mod_base = OTHER; note = 2'-O-methyladenosine-3'-phosphate
  modified_base 12: mod_base = OTHER; note = 2'-fluoroguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphorothioate
  modified_base 18: mod_base = OTHER; note = 2'-fluoroguanosine-3'-phosphorothioate
  modified_base 19: mod_base = OTHER; note = 2'-O-methyladenosine-3'-phosphate
aaccagaagaagcaggtga

SEQ ID NO: 2204 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agcttcctcgccatcacctccgt

SEQ ID NO: 2205 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
attggagtcctcacaggccttga

SEQ ID NO: 2206 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atcttggagtcctcacaggcctt

SEQ ID NO: 2207 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
actcttggagtcctcacaggcct

SEQ ID NO: 2208 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
acctaggaaataccagagtagca

SEQ ID NO: 2209 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agtaccctaggaaataccagagt

SEQ ID NO: 2210 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atgtaccctaggaaataccagag

SEQ ID NO: 2211 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
attgtaccctaggaaataccaga

SEQ ID NO: 2212 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aacctccgccttgtaccctagga

SEQ ID NO: 2213 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agagtacacctggctgaccatca

SEQ ID NO: 2214 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
acctgagtacacctggctgacca

SEQ ID NO: 2215 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgcctgagtacacctggctgac

SEQ ID NO: 2216 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atgggagaagtggcgattgagta

SEQ ID NO: 2217 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aagatcctgggagaagtggcgat

SEQ ID NO: 2218 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaagatcctgggagaagtggcga

SEQ ID NO: 2219 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
acggcgggtaagatcctgggaga

SEQ ID NO: 2220 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atttcactgcggaaggcactaga

SEQ ID NO: 2221 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atggcggtttcactgcggaaggc

SEQ ID NO: 2222 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
actttggcggtttcactgcggaa

SEQ ID NO: 2223 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agctttggcggtttcactgcgga

SEQ ID NO: 2224 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aagcatcttctgggctttggcgg

SEQ ID NO: 2225 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaagttcccaggcgggtgctggt

SEQ ID NO: 2226 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aatagacggagctggagttgtag

SEQ ID NO: 2227 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atgaaccagaagaagcaggtgag

SEQ ID NO: 2228 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aagaatgaaccagaagaagcagg

SEQ ID NO: 2229 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attggagaatgaaccagaagaag

SEQ ID NO: 2230 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aatttggagaatgaaccagaaga

SEQ ID NO: 2231 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agatttggagaatgaaccagaag

SEQ ID NO: 2232 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agtggacagcagctcctccacca

SEQ ID NO: 2233 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aactgtggacagcagctcctcca

SEQ ID NO: 2234 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agttgactgtggacagcagctcc

SEQ ID NO: 2235 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agagctgttgactgtggacagca

SEQ ID NO: 2236 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
acacttcgtactcggccctgtag

SEQ ID NO: 2237 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agtccacttcgtactcggccctg

SEQ ID NO: 2238 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atttcacactggcttccaggatc

SEQ ID NO: 2239 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atctttcacactggcttccagga

SEQ ID NO: 2240 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atatgtctttcacactggcttcc

SEQ ID NO: 2241 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agctatgtctttcacactggctt

SEQ ID NO: 2242 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aatgcagctatgtctttcacact

SEQ ID NO: 2243 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atagcggtaacaacccagcgtgg

SEQ ID NO: 2244 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agtagcggtaacaacccagcgtg

SEQ ID NO: 2245 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atgtagcggtaacaacccagcgt

SEQ ID NO: 2246 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
actgtagcggtaacaacccagcg

SEQ ID NO: 2247 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agtgatgagcctcttctccaggg

SEQ ID NO: 2248 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agaggtgatgagcctcttctcca

SEQ ID NO: 2249 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
accgaggtgatgagcctcttctc

SEQ ID NO: 2250 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atacaccgaggtgatgagcctct

SEQ ID NO: 2251 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atagctgtgcaggcccttcttcc

SEQ ID NO: 2252 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atagtagctgtgcaggcccttct

SEQ ID NO: 2253 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acaagccgtagtccagagagggc

SEQ ID NO: 2254 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agccaagccgtagtccagagagg

SEQ ID NO: 2255 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agagggccaagccgtagtccaga

SEQ ID NO: 2256 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aagagggccaagccgtagtccag

SEQ ID NO: 2257 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agcacggcaaatcatacttctgc

SEQ ID NO: 2258 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atgcacggcaaatcatacttctg

SEQ ID NO: 2259 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agtgcacggcaaatcatacttct

SEQ ID NO: 2260 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agggtgcacggcaaatcatactt

SEQ ID NO: 2261 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
attctggatcgtccactggccct

SEQ ID NO: 2262 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agttctggatcgtccactggccc

SEQ ID NO: 2263 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
actcctgttctggatcgtccact

SEQ ID NO: 2264 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atgagggagatctgggaggtgaa

SEQ ID NO: 2265 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
acaagccatagtgcacccgcaca

SEQ ID NO: 2266 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aacaagccatagtgcacccgcac

SEQ ID NO: 2267 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atacaagccatagtgcacccgca

SEQ ID NO: 2268 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atttctctcatccaggccgttgg

SEQ ID NO: 2269 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aagtttctctcatccaggccgtt

SEQ ID NO: 2270 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
actctgcaaacgcagtttctctc

SEQ ID NO: 2271 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aatgtggctctgcaaacgcagtt

SEQ ID NO: 2272 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaatgtggctctgcaaacgcagt

SEQ ID NO: 2273 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aggaatgtggctctgcaaacgca

SEQ ID NO: 2274 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agcactggaatgtggctctgcaa

SEQ ID NO: 2275 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acactggaaggtgaatgtcccac

SEQ ID NO: 2276 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aacactggaaggtgaatgtccca

SEQ ID NO: 2277 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atcacactggaaggtgaatgtcc

SEQ ID NO: 2278 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
attgggcttcttcacgcagctcc

SEQ ID NO: 2279 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agttgggcttcttcacgcagctc

SEQ ID NO: 2280 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aggttgggcttcttcacgcagct

SEQ ID NO: 2281 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agggttgggcttcttcacgcagc

SEQ ID NO: 2282 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agaggccacagtcacagtgctcc

SEQ ID NO: 2283 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aatggccactcaccctcggagga

SEQ ID NO: 2284 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aatcacccagcggtcagcgatga

SEQ ID NO: 2285 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atatcacccagcggtcagcgatg

SEQ ID NO: 2286 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agttatcacccagcggtcagcga

SEQ ID NO: 2287 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aggcagctgttatcacccagcgg

SEQ ID NO: 2288 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aatgctgtcctcctggaagcagt

SEQ ID NO: 2289 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
accatgctgtcctcctggaagca

SEQ ID NO: 2290 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
attctgccacaccttgcccagga

SEQ ID NO: 2291 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agttctgccacaccttgcccagg

SEQ ID NO: 2292 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agagttctgccacaccttgccca

SEQ ID NO: 2293 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaaggacacctctccaggccagc

SEQ ID NO: 2294 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atgaaggacacctctccaggcca

SEQ ID NO: 2295 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
attgaaggacacctctccaggcc

SEQ ID NO: 2296 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acctgtgggatcaactgcacatc

SEQ ID NO: 2297 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agtcctgtgggatcaactgcaca

SEQ ID NO: 2298 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
actgcacaggtcctgtgggatca

SEQ ID NO: 2299 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acgctgcacaggtcctgtgggat

SEQ ID NO: 2300 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atcgctgcacaggtcctgtggga

SEQ ID NO: 2301 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agcatgcgtggcgtcacctggta

SEQ ID NO: 2302 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acacagcatgcgtggcgtcacct

SEQ ID NO: 2303 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aacacagcatgcgtggcgtcacc

SEQ ID NO: 2304 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agcacacagcatgcgtggcgtca

SEQ ID NO: 2305 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attcttgcccttgcggtagccgg

SEQ ID NO: 2306 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aggccactgagtgccttgcacac

SEQ ID NO: 2307 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtagacgccgaagtagttaggc

SEQ ID NO: 2308 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acacctgtgatgcgggtgtagac

SEQ ID NO: 2309 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agatcacacctgtgatgcgggtg

SEQ ID NO: 2310 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtcaccacttgctggatccagc

SEQ ID NO: 2311 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acaggtcaccacttgctggatcc

SEQ ID NO: 2312 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
actcaggtcaccacttgctggat

SEQ ID NO: 2313 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
acctcaggtcaccacttgctgga

SEQ ID NO: 2314 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attcctcaggtcaccacttgctg

SEQ ID NO: 2315 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agatgccacctcctgccaccaca

SEQ ID NO: 2316 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aagatgccacctcctgccaccac

SEQ ID NO: 2317 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaagatgccacctcctgccacca

SEQ ID NO: 2318 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aatcctcctgccatcactggagc

SEQ ID NO: 2319 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aattcccagatcccaagttagac

SEQ ID NO: 2320 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
acaaagggcagctgagctcacct

SEQ ID NO: 2321 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atattccaaagggcagctgagct

SEQ ID NO: 2322 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
attattccaaagggcagctgagc

SEQ ID NO: 2323 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aggcagctttattccaaagggca

SEQ ID NO: 2324 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aaggcagctttattccaaagggc

SEQ ID NO: 2325 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atcaggcagctttattccaaagg

SEQ ID NO: 2326 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Guanosine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aatcaggcagctttattccaaag

SEQ ID NO: 2327 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Guanosine-2'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agatcaggcagctttattccaaa

SEQ ID NO: 2328 - RNA, 23 nt, Homo sapiens
  source 1..23: mol_type = unassigned RNA
cccctcacctgcttcttctggtt

SEQ ID NO: 2329 - RNA, 21 nt, Homo sapiens
  source 1..21: mol_type = unassigned RNA
cctcacctgcttcttctggtt

SEQ ID NO: 2330 - RNA, 19 nt, Homo sapiens
  source 1..19: mol_type = unassigned RNA
tcacctgcttcttctggtt

SEQ ID NO: 2331 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
gacgccacgcatgctgtgtgt

SEQ ID NO: 2332 - RNA, 19 nt, synthetic construct
  source 1..19: mol_type = other RNA
  modified_base 1: mod_base = OTHER; note N-[tris(GalNAc-alkyl)-amidododecanoyl]-(S)-pyrrolidin-3-ol- phosphorothioate (p-C12-(GalNAc-alkyl)3) 2'-fluorouridine-3'-phosphate
  modified_base 2: mod_base = OTHER; note = 2'-O-methylcytidine-3'-phosphate
  modified_base 3: mod_base = OTHER; note = 2'-fluoroadenosine-3'-phosphate
  modified_base 4: mod_base = OTHER; note = 2'-O-methylcytidine-3'-phosphate
  modified_base 5: mod_base = OTHER; note = 2'-fluorocytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-fluorouridine-3'-phosphate
  modified_base 14: mod_base = OTHER; note = 2'-O-methylcytidine-3'-phosphate
  modified_base 15: mod_base = OTHER; note = 2'-fluorouridine-3'-phosphate
  modified_base 16: mod_base = OTHER; note = 2'-O-methylguanosine-3'-phosphate
  modified_base 17: mod_base = OTHER; note = 2'-fluoroguanosine-3'-phosphorothioate
  modified_base 18: mod_base = OTHER; note = 2'-O-methyluridine-3'-phosphorothioate
  modified_base 19: mod_base = OTHER; note = 2'-fluorouridine-3'-phosphate
tcacctgcttcttctggtt

SEQ ID NO: 2333 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate N-[tris(GalNAc-alkyl)-amidodecanoyl)]-4-hydroxyprolinol (Hyp-(GalNAc-alkyl)3)
cctttggaataaagctgcctt

We claim:

1. A double stranded ribonucleic acid (dsRNA) agent for inhibiting expression of Transmembrane protease, serine 6 (TMPRSS6) in a cell, or a pharmaceutically acceptable salt thereof, comprising a sense strand and an antisense strand forming a double stranded region, wherein the nucleotide sequence of the sense strand differs by no more than 4 bases from the nucleotide sequence 5'-asgscugcccUfUfUfggaauaaagu-3' (SEQ ID NO:395) and the nucleotide sequence of the antisense strand differs by no more than 4 bases from the nucleotide sequence 5'-asdCsuudTadTuccadAaGfggcagcusgsa-3' (SEQ ID NO:521), wherein a, g, c and u are 2'-O-methyl (2'-OMe) A, G, C, and U, respectively; Gf and Uf are 2'-deoxy-2'-fluoro (2'-F) G and U, respectively; dC, dA, and dT are 2'-deoxy C, A, and T, respectively; and s is a phosphorothioate linkage, and wherein the dsRNA agent is conjugated to a ligand.

2. The dsRNA agent, or a pharmaceutically acceptable salt thereof, of claim 1, wherein the nucleotide sequence of the sense strand differs by no more than 3 bases from the nucleotide sequence 5'-asgscugcccUfUfUfggaauaaagu-3' (SEQ ID NO:395) and the nucleotide sequence of the antisense strand differs by no more than 3 bases from the nucleotide sequence 5'-asdCsuudTadTuccadAaGfggcagcusgsa-3' (SEQ ID NO:521).

3. The dsRNA agent, or a pharmaceutically acceptable salt thereof, of claim 1, wherein the nucleotide sequence of the sense strand differs by no more than 2 bases from the nucleotide sequence 5'-asgscugcccUfUfUfggaauaaagu-3' (SEQ ID NO:395) and the nucleotide sequence of the antisense strand differs by no more than 2 bases from the nucleotide sequence 5'-asdCsuudTadTuccadAaGfggcagcusgsa-3'(SEQ ID NO:521).

4. The dsRNA agent, or a pharmaceutically acceptable salt thereof, of claim 1, wherein the nucleotide sequence of the sense strand differs by no more than 1 base from the nucleotide sequence 5'-asgscugcccUfUfUfggaauaaagu-3' (SEQ ID NO:395) and the nucleotide sequence of the antisense strand differs by no more than 1 base from the nucleotide sequence 5'-asdCsuudTadTuccadAaGfggcagcusgsa-3' (SEQ ID NO:521).

5. The dsRNA agent, or a pharmaceutically acceptable salt thereof, of claim 1, wherein the nucleotide sequence of the sense strand comprises the nucleotide sequence 5'-asgscugcccUfUfUfggaauaaagu-3' (SEQ ID NO:395) and the nucleotide sequence of the antisense strand comprises the nucleotide sequence 5'-asdCsuudTadTuccadAaGfggcagcusgsa-3' (SEQ ID NO:521).

6. The dsRNA agent, or a pharmaceutically acceptable salt thereof, of claim 1, wherein the nucleotide sequence of the sense strand consists of the nucleotide sequence 5'-asgscugcccUfUfUfggaauaaagu-3' (SEQ ID NO:395) and the nucleotide sequence of the antisense strand consists of the nucleotide sequence 5'-asdCsuudTadTuccadAaGfggcagcusgsa-3' (SEQ ID NO:521).

7. The dsRNA agent, or a pharmaceutically acceptable salt thereof, of claim 1, wherein the ligand is conjugated to the 3' end of the sense strand of the dsRNA agent.

8. The dsRNA agent, or a pharmaceutically acceptable salt thereof, of claim 1, wherein the ligand is an N-acetylgalactosamine (GalNAc) derivative.

9. The dsRNA agent, or a pharmaceutically acceptable salt thereof, of claim 8, wherein the ligand is one or more GalNAc derivatives attached through a monovalent, bivalent, or trivalent linker.

10. The dsRNA agent, or a pharmaceutically acceptable salt thereof, of claim 9, wherein the ligand is

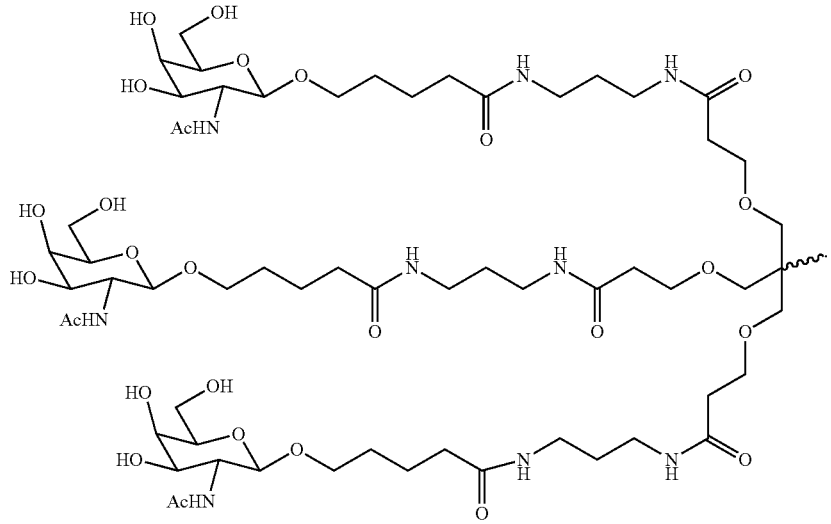 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

11. The dsRNA agent, or a pharmaceutically acceptable salt thereof, of claim 10, wherein the dsRNA agent is conjugated to the ligand as shown in the following schematic

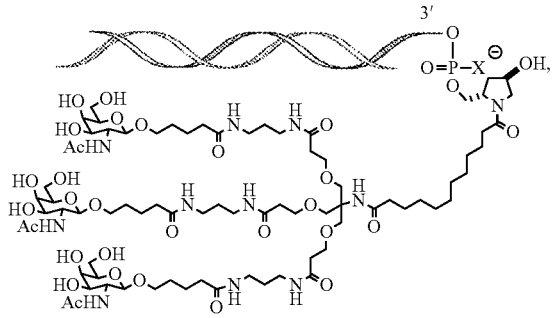

and, wherein X is O or S.

12. The dsRNA agent, or a pharmaceutically acceptable salt thereof, of claim 11, wherein X is O.

13. An isolated cell containing the dsRNA agent, or a pharmaceutically acceptable salt thereof, of claim 1.

14. A pharmaceutical composition for inhibiting expression of a gene encoding Transmembrane protease, serine 6 (TMPRSS6) comprising the dsRNA agent, or a pharmaceutically acceptable salt thereof, of claim 1.

15. The pharmaceutical composition of claim 14, wherein the dsRNA agent, or a pharmaceutically acceptable salt thereof, is in an unbuffered solution.

16. The pharmaceutical composition of claim 15, wherein the unbuffered solution is saline or water.

17. The pharmaceutical composition of claim 14, wherein the dsRNA agent, or a pharmaceutically acceptable salt thereof, is in a buffer solution.

18. The pharmaceutical composition of claim 17, wherein the buffer solution comprises acetate, citrate, prolamine, carbonate, or phosphate or any combination thereof.

19. The pharmaceutical composition of claim 18, wherein the buffer solution is phosphate buffered saline (PBS).

20. A composition, or a pharmaceutically acceptable salt thereof, comprising a sense strand and an antisense strand,
wherein the sense strand comprises the nucleotide sequence 5'-asgscugcccUfUfUfggaauaaaguL96-3' (SEQ ID NO:395) and the antisense strand comprises the nucleotide sequence 5'-asdCsuudTadTuc-cadAaGfggcagcusgsa-3' (SEQ ID NO:521),
wherein a, g, c and u are 2'-O-methyl (2'-OMe) A, G, C, and U, respectively; Gf and Uf are 2'-deoxy-2'-fluoro (2'-F) G and U, respectively; dC, dA, and dT are 2'-deoxy C, A, and T, respectively; and s is a phosphorothioate linkage, and
wherein L96 is a ligand conjugated to the 3'-end of the sense strand as shown in the following schematic

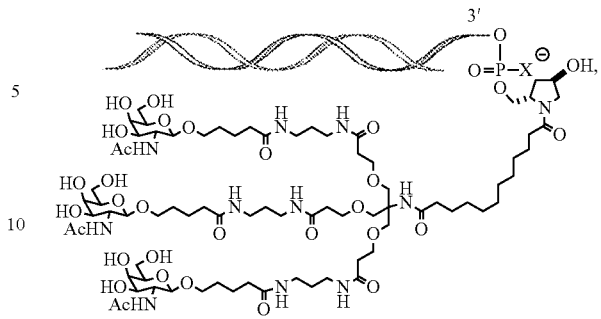

wherein X is O.

21. The composition, or a pharmaceutically acceptable salt thereof, of claim 20, which is in a sodium salt form.

22. An isolated cell containing the composition, or a pharmaceutically acceptable salt thereof, of claim 20.

23. A pharmaceutical composition comprising the composition, or a pharmaceutically acceptable salt thereof, of claim 20.

24. A composition, or a pharmaceutically acceptable salt thereof, comprising a sense strand and an antisense strand,
wherein the sense strand consists of the nucleotide sequence 5'-asgscugcccUfUfUfggaauaaaguL96-3' (SEQ ID N0:395) and the antisense strand consists of the nucleotide sequence 5'-asdCsuudTadTuc-cadAaGfggcagcusgsa-3' (SEQ ID NO:521),
wherein a, g, c and u are 2'-O-methyl (2'-OMe) A, G, C, and U, respectively; Gf and Uf are 2'-deoxy-2'-fluoro (2'-F) G and U, respectively; dC, dA, and dT are 2'-deoxy C, A, and T, respectively; and s is a phosphorothioate linkage, and
wherein L96 is a ligand conjugated to the 3'-end of the sense strand as shown in the following schematic

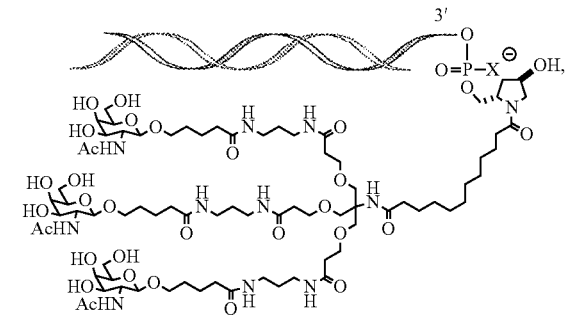

and wherein X is O.

25. The composition, or a pharmaceutically acceptable salt thereof, of claim 24, which is in a sodium salt form.

26. An isolated cell containing the composition, or a pharmaceutically acceptable salt thereof, of claim 24.

27. A pharmaceutical composition comprising the composition, or a pharmaceutically acceptable salt thereof, of claim 24.

28. A double stranded ribonucleic acid (dsRNA) agent for inhibiting expression of Transmembrane protease, serine 6 (TMPRSS6) in a cell, or a pharmaceutically acceptable salt thereof, comprising a sense strand and an antisense strand forming a double stranded region,
wherein the sense strand comprises the nucleotide sequence 5'-asgscugcccUfUfUfggaauaaagu-3' (SEQ ID NO:395) and the antisense strand comprises the nucleotide sequence 5'-asdCsuudTadTuccadAaGfggcag-cusgsa-3' (SEQ ID NO:521), wherein a, g, c and u are 2'-O-methyl (2'-OMe) A, G, C, and U, respectively; Gf and Uf are 2'-deoxy-2'-fluoro (2'-F) G and U, respectively; dC, dA, and dT are 2'-deoxy C, A, and T, respectively; and s is a phosphorothioate linkage, and wherein the dsRNA agent is conjugated to a ligand.

29. The dsRNA agent, or a pharmaceutically acceptable salt thereof, of claim 28, which is in a sodium salt form.

30. A pharmaceutical composition comprising the dsRNA agent, or a pharmaceutically acceptable salt thereof, of claim 28.

31. The dsRNA agent, or a pharmaceutically acceptable salt thereof, of claim 1, which is in a sodium salt form.

32. The pharmaceutical composition of claim 23, wherein the composition, or a pharmaceutically acceptable salt thereof, is in an unbuffered solution.

33. The pharmaceutical composition of claim 32, wherein the unbuffered solution is saline or water.

34. The pharmaceutical composition of claim 23, wherein the composition, or a pharmaceutically acceptable salt thereof, is in a buffer solution.

35. The pharmaceutical composition of claim 34, wherein the buffer solution comprises acetate, citrate, prolamine, carbonate, or phosphate or any combination thereof.

36. The pharmaceutical composition of claim 35, wherein the buffer solution is phosphate buffered saline (PBS).

37. The pharmaceutical composition of claim 27, wherein the composition, or a pharmaceutically acceptable salt thereof, is in an unbuffered solution.

38. The pharmaceutical composition of claim 37, wherein the unbuffered solution is saline or water.

39. The pharmaceutical composition of claim 27, wherein the composition, or a pharmaceutically acceptable salt thereof, is in a buffer solution.

40. The pharmaceutical composition of claim 39, wherein the buffer solution comprises acetate, citrate, prolamine, carbonate, or phosphate or any combination thereof.

41. The pharmaceutical composition of claim 40, wherein the buffer solution is phosphate buffered saline (PBS).

42. The pharmaceutical composition of claim 30, wherein the composition, or a pharmaceutically acceptable salt thereof, is in an unbuffered solution.

43. The pharmaceutical composition of claim 42, wherein the unbuffered solution is saline or water.

44. The pharmaceutical composition of claim 30, wherein the composition, or a pharmaceutically acceptable salt thereof, is in a buffer solution.

45. The pharmaceutical composition of claim 44, wherein the buffer solution comprises acetate, citrate, prolamine, carbonate, or phosphate or any combination thereof.

46. The pharmaceutical composition of claim 45, wherein the buffer solution is phosphate buffered saline (PBS).

\* \* \* \* \*

UNITED STATES PATENT AND TRADEMARK OFFICE
CERTIFICATE OF CORRECTION

| | | |
|---|---|---|
| PATENT NO. | : 11,866,710 B2 | Page 1 of 1 |
| APPLICATION NO. | : 18/150827 | |
| DATED | : January 9, 2024 | |
| INVENTOR(S) | : Aimee M. Deaton et al. | |

It is certified that error appears in the above-identified patent and that said Letters Patent is hereby corrected as shown below:

In the Claims

At Column 235, Claim number 11, Line number 29, delete "and, wherein X is O or S." and insert -- and wherein X is O or S. --

At Column 236, Claim number 20, Line number 16, delete "wherein X is O." and insert -- and wherein X is O. --

At Column 236, Claim number 24, Line number 28, delete "N0:" and insert -- NO: --

At Column 237, Claim number 28, Line number 1, delete "N0:" and insert -- NO: --

Signed and Sealed this
Seventh Day of May, 2024

Katherine Kelly Vidal
*Director of the United States Patent and Trademark Office*